United States Patent 11,001,841 (CCCTC-BINDING FACTOR (CTCF) RNA INTERACTOME) - sequence listing, part 58

SEQ ID NO: 136588 - DNA, 1008 bp, Homo sapiens
gcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggtgaggttttgcttggggaggatgcagagtgagctcaggagtggaggtgaccgagcctcccggtggtattgggactagtcagtgtcgggagcatgggtcaggagcctgggtcaggagggagacctggaactgggcgccctaagccatgctcgcgccgcctgtacccaggccagtccacgatctgggcgcaggcgtgtacggtcgtgggacttctagcttctggagggttcggctggaaagtcttgatgttgattgtcatggtttcagcctctgaacgtctgggaagggggtgtcctgtctgcattacttttagtgctaatgttcccaagattggggggatctctgacttccagatatcccctaatagttgagtggaggtgtagtctgttgtgtaatgatgaagggctcttaacagcttcccagccataggagtacaaagttactgatagggaaaaggagctttagaagtagtggaaagctgtgcagatggtggcaagatgtagatagcaaacgtaaagtcaaaggaaaagttctcatttgttttacgtgcagtgttttaaaatatatttcattgcaggatgttaccaagttgacgccactttcacacgaagttatcagcagacaagccacaattaacataggtaagagtaacttaagagacctaaccttggtctccaacaattaattttaacctcactttttgtgtgattacttgaatagtatgaggattcagatattcaagaaatagatactgagtccttgtgaataaagcatctgctacatttgcggtgcagggggagcacaaagaatgctgcccacatgtagcttacagactcgg

SEQ ID NO: 136589 - DNA, 1059 bp, Homo sapiens
ccacctcctgggttcaagtgattcttttgcctcagcctccccagtagctgggactacaggcatgcgccaccacgcccagctaatttttgtatttttagtagagatggggtttcaccatgttggccaggatggtcttgctctcttgaccttgtgatccacccacctcggcctcccaaagtgctgggattactggcgtgagccaccgtgtccagctggctttgggttttctactcttaacactatttgaaaaaatatttggtatgtaattaaatacacatgaattaattttttgaactttgtccataggtacaattggtcatgtagctcatgggaaatccacagtcgtcaaagctatttctggagttcatactgtcaggttcaaaaatgaactagaaagaaatattacaatcaagcttggatatgctaatgctaaggtaagctgtgtactgtggaacgagaaactaactttaattgttgtgcagataacaaatcaaaatctttttttattgaaattttagatttataagcttgatgacccaagttgccctcggccagaatgttatagatcttgtgggagcagtacacctgacgagtttcctacggacattccagggaccaaagggaacttcaaattagtcaggtgacctctcttttgctacaaacactacactttatattttattgtcttctgttttgtgctttttgaaatatcgaggtgttaaacggtgaacctaatggctaaatggttttgttgtttttccattgtttatgtttttatgggaaatctgaaaagtcaagcatctaaacctaagttaaaatacttacatgcaatttctccaaactaaaagtatcacttaaacaaaacagaaaaacaactcattggattgaagggattctttttctaggcttcctgaatttcttttaaacagcgctgtttctgtatgttaaataggagagaaacagagccatttctaattacttctctaaaacacttgaacttgttccccatctgttttctgaatatgattgcatacctgtttttttatcaggatactgaca

SEQ ID NO: 136590 - DNA, 1152 bp, Homo sapiens
ggccaaggcaggtggatcacttgaggtgtcaggagtttgagaccagtctggccaacatggtgaaaccctgcctctattaaaaatacgaaaattagccgggtgtggtggggcacacctgtaatcacagctactcaggaggctgaggcaggagaatcgcttgaacttgggaggcggaggttgcagtgagccgaggtgacgccactgcactccagcctgggtgacagagacagagtgagactcagtctcaaaaaaaaaattttttttttaaagcatgccatgttggtatagtcaggacacttgaatatcacgacttgaggaggttgatcattagagtgctcaacaaaacatgcctatttctttataatacactgttggttatcttcacaatagcattcttccctccctcagttgaagagtagcctctgatattagtaaaaattcatagacagtattaagtgcttttcccttttaattactctctacttctcaggagcttgcctgggccagaacatttctaaaactggagagagttagagggctatacctcatacctgagcaaaagctgagtgcagaccctgagaaaagccaaacttgctgattttaagcttcttgcttaggaccaggattgggagccacacaattgggaggttccagtgaatgcaggcaacagaggatgaagcagggccaaaaggtggatacctggcaataatatcttccttattagggttagaacattcagaagtctcctttattagatgccaactttttttggggcggggagtgggtggcaaaagagactcataaaatgtaccattttatgtatttacagggtagaatttagtggcattaagcacattgacaattttctacaacatagtggttgtcatttcaccactatctagttccagaacttttgtatcagaacttttgtatcaccgcaaaaggaaaccccatgcccatgaagcgtcagtccacatgttttcctcccccagccccttgcaacccataatttgctttgtctctttatggatttgcccgcctattctggatatttccagctattcttatatgcatcttttttattcttcatcaactagctggtaatgaatcttgccctcagcctcagacatcggaacacctggctgctataga

SEQ ID NO: 136591 - DNA, 1561 bp, Homo sapiens
gagtctgtaattttatcttgacatttattgggagattaattacatgttgttagaaattttttcaactagtagagtgctctttcacaggaatgttagtattttctttatttaaataagtttatcattgtactaatattaagtatgtctactaatataatgtaacaaattttctcttacagggatttgtattcattttcaggagtaaaaacaaacaatattgccatctttctaaacagaattatccactttccacttgttgctgacatttatatggggtttaggcatctattttattatagtaatcttaattgttttatgtaacagatacatagaataaattttataaaactgtataattttgatctttctaaattttgtcatataggtacagtagcagagggagctcccattattccaatttcagctcagctgaaatacaatattgaagttgtttgtgagtacatagtaaagaaaattccagtacccccaagagactttacttcagagccccggcttattggtaagtgataggatttgcctttaactcttaatctgatcttttccacattggtgattcctcttcaaggatgtttattaatatttcctctttctgcagaggtgataattcatacaatttttttgaaatcaattctgagattgtattggcagtgctagattgtattactgaatgagggacagagtcctgaacacagtaagaactgttaacctaagccgggcgcagtggctcacgcctataatcccaatactttggggggccgaggtgggtggatcacctgagttcaggagtttgagaccagcctgatcagcatggtgaaaccctgtctctactaaacatataaaaaattaactgggcatggtggcgggtgcctgtaatcccagctactcgggaggctgaggcaggagaatggcgcgaacccgggaagcggaggttgcaatgagctgagatcgcgccattgtactccagcctgggcaacaagagtgaaactgcgtctcaaaaaaacccaaaaacaactgctaacctttctgtgcttaatatatggtacatgatcaagatggagtaatacagtattctccatggaatcataatgttttagggtgttagaacttcctgactaaaacatttacagatgattttgttgttcaattaacgaagaactgatactggtataatttgatcacctaggcttgtggttcctacacggggatgtagtagccttctcgaaacagacatttgagctcctctggctttcatccgagcttctggtgtttagtaggaaatagtctccgaagtgcaggtcatgtagtcctagtgttttatagttataaagctgaattgttcttacaggagttacagaggtctataaagaaaatgtccataatctctctgtcttcaagttctagttccttagccctaaagtcagcaaagttaacatttggtgtccattattcccacacttttctctttgttcatatcatcgtgtataaacatatacacaggctgggcatggtggctttcacctgtaatcccagcactttggga

SEQ ID NO: 136592 - DNA, 1325 bp, Homo sapiens
taccctattttttaaaggtagatcttgtgtaaattcagtgggtgccaaataaactatactatatatagttcaaattcctttacaatgaaatttctatagaattttttttatgattgacatatttcccaatagtatttggtaaattcttacttacatttggaaagcattttcttgattttggggtttatttttccctaatttatttttctaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccgggtgcggtggctcacgcctgtaatcccagcactttgggaggcctaggcgggtggatcatgaggtcaggagatcaagaccatcctggctaacatggtgaaaccccgtctctactaaaaaatacaaaaaattagccgggcgtggtggcgggcgcctgtagtcccagctactcgggaggctgaggcaggagaatggcgtgaacctgggagtcggagcttgcagtgagccgagatggcgccactgcactccagcctgggcgacagagcgagactccgtctcagaaaaaactacaaccttgactatagtcccatattttagtccaaatactgtgattggcttctcttcctgttagacacaacctatgcaaaaccaaatgaatttgggttcggtatttctatcgtcattggctttggaaatcatttcacacttaatagaaaaattgtaagagttttacagaaaactcctctatagctttttcctagattgacaaacacacatacagatttatttacatatataagtttttttctgaaccatttgagtgtaggctatatatgttatgcttcttgatctcttaatacttcagtgtatatttcccatcaaaaaaggatattcttatgtaaccacttagaaatttaacattggcaaaatactgaaatctacagtgcatgtttcagttttattacttgtcccaataatgtactttatgttcctcctgtttagaatcttgaattgcatttaatttcatgtctctttgatctttaatctggagctttttcagcctttgtctt

SEQ ID NO: 136593 - DNA, 1353 bp, Homo sapiens
tgagcccttaagccacacactctccccaaggagaataattttaaaataaacaatgactggcaaataggtgattttcaagcagtgctttttacatgagtcattagtcgaacaagacattgtttaattcctgaaaataatagccaaattcttcatggattataaatcacagggcacagcaaacaaactagctccactaaagagataaaaaaatcaatatagaggcctagaaacaatgagcagtagcagtgagcacccctggtgtccaagttggggcctctacagtttcccaccaaaggaaagggagaagtgattgattccagggctggagcaggaaagtataagataagccaggaacatctccttatagcagaaagcaaaagaagaaagtgtccaagcttactaggttgtctaacattaagaaaatttggatgtcaaaaaaaattgctatggagtgaaacatagtggatatgttaatgaatttatgagactttaaaaatgatcaactagtggtgatggttgcacaactttgtaaatgtactagaaattagtgacgtatgtatgctttaaaagggtgaatttgatagtataagagtcatatttcaattttttaagtgatcacttttggagaatgctagggaaccaactcaatattttgaaaactagtgaaggaaaagagatgaagcctgtaagatctactcctcagagtaaccaaatagttgacgaagggaccttccttttaatagaagtattccaactaatacatgaagaagtcctgatgaaattagaatatcaccattttggattttgtcgactgcaaaatatcaccattttgcaacatctaatgaattaatggaccttggcaatgatcatcagtggctgctaagcagagagaaaaccagaaacatgcctcaagatggaaggacaaaatgctactagacaaaaaaaaaaaaaaaaaaaaatcgaacctgagtttgatcaaccttctagctctaactaccagtttacaggaaatacaggaaacagagaaacatatcaatgaaaccacagggatgcggtcgacaaaatccagttgatgagaaactctaaaggacaaatgaaagataagaataaacaaataaattataagaaaacaaattataagaaaaattcaacatttaacaaatacatttcttcaacaaacaacttattagaaaaaaataggaggggaatcaatagattagaaaagacttaaaagacatgttcatcaatggcagtgtatgaacttcatttcatttttttttcttgtggcagggtctctctctgttgcccaggctggagtgtagtagtgcaatcacggcacactgcagcctcgac

SEQ ID NO: 136594 - DNA, 1064 bp, Homo sapiens
tgactggctgcagtttccgctgcgtttcagctgagctgccgcaggcggccaccgccgccgcccggacgccgggaccgtttcaccctcagcgcccctggccctgcgccttcccccgcgcctgtagccacccgagggcagtcggggcaggtggcattccggacacctgggcttaccagggcatacgggaccccaggaaatgttatttttgcttaagtcaaatcatatgtggctgctaaggtgctttcgatgcagttgtttttccaacaatctttgccgccccgagtatctgaataaaggaagaaaaataaagattgatgggaaagtttttgccattcttttgtcctatagggaaaaaaattgcacaacacgagagcggaggaataaaattttgaatcattcgtactcatttatgtggaaacaactttcttgaaaaacgatttaagtagtgatctgttggtggtatttttttaaatcgaggaataagggcagacttttttattttcttattggaggacaacttagtgtggtgcatatttattgtgcatttgcctgtcatggtatttcgatttttcatttgtgaagttttaaggcggagtttcatcccctaacgtacttttttgattgcacactgtgcaactttcttgataaactcggagcctactgttagcgatgcaccgtgctagatgctaagaaacattaaaaaggttcttgtaatgcagacggtggctgcaagaagtctcatgtttagaggtaggtggggcaaggtgaaatgcagtaaagtgagaggtacaactaattactgggatttccgagggaagcaaggttgccattggaggatcagggagggacgggttcctgaagtattaataggtggcattttgagaaggttaccgagggatgggtaggactttgttaggtagaggtggaggtggagaaaggacgtttcaagggtgaagcttcttcagtaaacagtaagtatttacagtttggcaaaagtggatggtataggtaggggagtggtgggaattcaggctagaaaagttagattgcagaagggcttgctt

SEQ ID NO: 136595 - DNA, 1805 bp, Homo sapiens
agcggtgctccatgaaagggctggagggaatgagagtctcatgtttattataaagggctatggtttagaaaagttcgagaaacagtgcattgcatgaggctgactagaagcaagttgagaaggcgggctgtggttgttgaggtgttaagggtaaacataaacttagaagaaccaggtgcttttatattttgacagctgggaaagacatagaagaactattaagaagatagaattgttttgctgcgcagtacagcaacagtggatgttcaagattaagattagagtcaagttgtgtgattaagacaggtaagtgtgtagtttagtttcaattagaaatggttaaatataaaattatttttgcctgaaagggtagaccttgaaactttggaaaactgactggtggaacaccttcgaacccaaccaccctggatgaataaggtgttagtttttaatttctgtgtatttttcagatagatgcagatttctttttttaaaaaaacatgctcacgaatgtgttacaaatttttttttccacattgctttttgtaaatgcttactctcattgcaaatgcttactctcacttaacccatttagactgattctgtcactgataatcttctttgtattatttgttcttgtgtacactggcaattccaaactttttttcactcttaaaactactcaacgggtccttgaaatctctcatcttcagcaaagattacccagtctttcacttcactgagaagggtagatggccatctgataaagagccaagtctcccctcccttccccttcatgcctttcctgtcttcacctaggccttcctccttttgccgcaggggaggttgcaggagggattgctgtctcacaagccccactgctgctctgagcctgctcttcaccctggctgcctccttagggaccaagctctgtgcgtgatgccgtctcttgcatcattaacctctctttacaaatattcctaggtttgctcatcttacaaaagcctcacctgtcttcactttctttgcaccccacttattcttaaatccagtattacccaaattgggaaacttgcacagcatgttaacaggtgtgttatataaaagtgctctgtgtttcagaaactctctgtgccttctctgtcttctatggtgggattccccttaatttatcatttaatgtattatatttgaactgtgtgtttatattttttccttctacactgtgaatatagagacaagttctgatttatctttgtctccaagcagtacctggcatatggaccattatctctcaaagcaataatttcggttactgggtacagagaattctacgtagttaatagttttcagctgttcaaaaatcaggtatccagtcagtgtgttttttgactcagggacatacatattaaggcacacttattagggcaccaggtcaaggagtaacccctcccaccaccccttatctgattggaatatggccagcctattcttattcctgccaagttatttttccagacaacattttataaaacccaggtatcttgtaattgtattttactcaaaggaagtatactctaaggaaattgtgtggccttgaggtacacagccattaggcatttaaaaaatatatttaaaaagttttatggaatatttttaaattactgaaaatcagaatcacccagatttaagagatcttaatattttgctacatatttgattcatatctttttgttgtttaaagaaataaaatctcacagattcaaagggtccctccccatccccttcctgtcttcttttctcca

SEQ ID NO: 136596 - DNA, 1687 bp, Homo sapiens
cttttaaatatctcagttttaatttctagtatgataaacatctatagatacgacccacgtaaaaactctttgtggttcttaatttttgttttttgttttgttttttaaattttattgtgatccttaatttttaagagtgcaaaggagtcctgagaccacgaagtttgaaaactactgattccattcattttatttgtatttcagtgtataaataaatatactgtggtttatttatcttttcttcttggagggaccgatagaaactgtttgcagtttctgaatttcaaacactactgctatgaacatccttatacatggtttgtctttcttgggattatatacatatagtagaagtagaattgcttcatttaagaagtctgtgcattatcaactttactgggaattgccaaaatggcaaattgtcttctatttgacactcccgctgtgtttgatcccgtttctccaaatcactgccaaaggattagattttgcaattttttcccaatctgttgggtataaatggcatctccttgctattttcattttgcatttctaagattactagtgaggttgaccttttttccccatgtatttatcggccatcagagttttctattaattgcttgtgcatacctttggttcatttttctgttggattgttgcctcctccttattggtatatgggttttatttatttatttatttatttgagatggagtcttgctctgttgcccaggctggagtgcagtggcacgtggtctgggctcactgtagcctctgcctcccaggttcaagcaattgtcctgcctcagcctcctgagtagctgggataacagacgcctgccaccatgcccggttaatttttgtgctttaagtagagacggggtttcaccatgttggccaggcttgtctcgaactcctgacctcaagtgatcggccctccttggcctctgaaagtgctgggattacaggtgtgagccactgtggctggctggtttatgggttttatattctggatactaatttgtgattatatacactgaaaatatcttttcctggtctgtggcttggcttttagctctgtttgtggaaagttttttatgtaggacttcataatatgatggtagccagttctcagtttttttcatttatggcttgtgttttcttatgtcttcaatacattcttcccttaccccaaggttgtaatgatactgtgctgtttcatatttaggtcgttaattcaccggagttttttgtatattgtgtgacgtaggaatctaatatctttttcatgtggatttatcaaatggttcagcgtttctccccactgatttataatgcaactcctgagatatatcatattcccacatatgtatctgtttttagtttctctcttttggtttcattggtctgtttgcctatctctatatctatactatcctgatttaataatagcctttttttttttggagacggagttttgctctgtcgcccaggctggagtgcagtggtgcgatctcagctcactgcaagcttcacctcctgggctcacgccattctcctgcctcagcctcccgagtagctgggactacaggcgcccgcaaccacgcccggctaattttttgtatttttagtagagacggggtttcaccgtgttagccaggatggtctcgatctcctgacctca

SEQ ID NO: 136597 - DNA, 1133 bp, Homo sapiens
ctaatagagctgggatttgaattctgggtatgtgctactacttttcataaagctcttgcacaacttttgttagatatttttgttagatactgtgtaatttttgttgtcattgtgaataggattttcttttagttatagttgctattattgctgatgtataaggatcactgttgacttatatgtattgatcacgtaaccttgctgaactctcatcatatttcatagattctgaggtacacttttcccccctacatcttcacatatctgaagtcaaaatagatctttgatggtgtcccataatcactgttgtctaggcagcagtcatgatgtagttatcattgcttgcacatgcacaaacttggtcagggctcttcattttgtcatcactttaaatgagtatgtgcattgctgtattgttatttcatgccaaacaataaaactggaggcggaagaaattgcaaagtgggtgtctgccttgaaagaaaatcccataaataataatggatcattttaagaagtgctgcatcaccaacactcttattggcagagcacaatattgttagcaacagttgaacagttttgagtggaagagcaatccatagtaggaccttgaatgtgaagttgtaggaataccttaccaatttattttgcttcttttttttctgtcgcccaggctggagtgcagtggcacgatctcagctcactgcaacctccgcctcccgggttcaagcaattctcctgcctcagcgtcccgagtagctgggactacaggtgcacgctgccacgcccagctaattttttgtattttagtcgagacaggttttcactgtgtttcccaggctgttctcgaactcctgaacccaggcaatctgcccgcctcggcctcccaaagtgctaggattacaggcatgagccactgtgcccggccaatttcttttgcttctgtatacacaagatatgataaaagtctgtctaaataagtctgaattgtcttgataaatctagaatgaaaatcctagataataagaaaatactgtatcagtttaattggcaatgtttttttcttagtcatgtaaaataagggtacagcttacaattggtatcttcagagtcagtgaaatgtagtagtaata

SEQ ID NO: 136598 - DNA, 1191 bp, Homo sapiens
acagttgctgtttaatagagacaatctgtttcttttcttttttggagacagaatctctctcttgtcgcccaggctggagtgcagtggcacgatctcggctcactgcaatctctgcctccctggttcaagtgattctcctgcctcagcctcctgagtagctggattacaggtgcccgccaccatgcctggctaatttttgtagtttttagtagagatgggtttcaccatgttggccaggcctcaggtctggtctcgaactcctgacctcaggtgatgggcctaccttgacctcccaaagtgctgggattacagacatgagccaccgtgtccgagcgagacgatctgtttcttaaaagtaagaacccatctgtgagattatctgtgcttggtgtcttttgagtgtaaatttgtggtttctgatttgttaattgtttctttcatgatgataagtcttgttttagctgttcttgagtttttttggtcatttatacaaaatgaacaattttctagaaaaatattaaatttcaaatgcattattataaaatacagatttccctgatgacttttaaaaacctaattttgttagtttgttcctttttttctgatcagtattgccagtaactgcctttattattggattttttaacatagttatttttattgatcctttctatttctactcctgtggttaatattttccttctgctttatttgcattcattctgacatttaaaaatgtaagttagaggcttagctcattcatatttaatctatttttataatatatatactaaaaactataaaattttctctagactataattggatgctatttaaaaaaattgaaatgcttttttttttttttttttgagagcgggtctcgctctgtcgcccaaggtggagtgcagtggcgcactctcggctcactgtaacctttgcctcccgggttcaagcgattctcttgcctcagcctcctgagtcgctgggattacagacgtgcaccagcacacctggctaatttttgtatttttagtagagacggggtttcaccatgttagccaggctggtttcaaactcctgacctcaggtgatccacctgcctcggcctcacaaagtgctgggattacaggtgtgagccactgagcccagccgaaatacacgtatttatggggtagagtgattatgtacatg

SEQ ID NO: 136599 - DNA, 1356 bp, Homo sapiens
aactccagaggggttacaaagttgaggtatagtcatctctgtttagaatgtttgaatttttgtaatgacaaaaccgaagggaaaatgaccaggcaaaacaatagtttgttgaataattactgctcacttaagatgagatgagcgggcacccccatgtaggccagaatatctattaggaaatgcacgtgatgtaaaaggatgggaagaaagcaaatcagtctgttaatggtagcttgggttaatactgcagagcctttgagtattgaggaactgctgaagtgttcagagcagggaagtagtatgatcaaagcagtgcttcaggagggttaatttgcctacagattgcagaaatgcctcaatacttggcaccagcccttacgtgtagttttagggtttctagtcatttgttgtgggagtggcagaaaggagcaaggccagtccagaggctattttcatcccccagggatcaggaaatatgaagctgagtgggaatgctaactaggaattaaaaaaaaaaaaaaaagattcttgagaagttgagaattgacaagatctggcaatctgactgtgagcagagaagaagaaaaaggccatagtggtcatatcaggagaaggctgggttttatccggatgagaatattcaacagtctgttggacatgttaggatgattgtaggaatcattgttgtggaaatagtagttgaaaccatgggaataaagagaaagcagaagaggagagggttgagcacacacctgggctgagccgcagtaaggggtgaggggagggtgagcagccagcagttaagaagagggaagagaactagaagtcacttaaagcaacagaggaaggagagcacttcacaaattagggagttgattgtttaatagaaatgccaaggaggatgaatgccaagaaaagttgttctgcaagttgagaatccgtagagctgatgggattgggtttatgtagggaaatttgtgcggtgaggggcttaaataccttaatgtatcccctttattgccttcttaattggcttgctttaatgtcatagtgtttcataatgcttagaatttttttttttttttttgagacagagtctcgctctgttgcccaggctggagtgcagtgtcgcaatcttggctcactgcaacctccacctcccggattcaagtagttctccctgcctcaacctcctgagtagctgggattacaggcacctaccaccacgcctggctaatttttgtatttttagtagcaatggggttgcgccatgttggccaggctggtctcgaactcctgacctcaggtgatccacccgtctcagcctcccaaagtgctgggattacagatgtgagc

SEQ ID NO: 136600 - DNA, 1347 bp, Homo sapiens
taatttctaatattctttggcctttgattttttttttttttttttttttgagacagtcttactctgtcgcccaggctggagtgcagtgatacaatctcggctcaatgcaacctccgtctcctgggttcaaggattctcctgcttcagcctcccgagtagctgggattacaggcatgcaccactacgcctggttaatttttatatttttagtagagacggggtttcacaatgttggccaggctggtctcgaacccttgacttcaggtaatctgcccaccttggcctccctaagtgctgggattacaaggcgtgagccaccacgccagacctgatcatttttggttgttgattaagctgtgtatttctctgagggcctggccagtgacacatagtcattgagttaggcacctggttggactcagcctggtctgagtcaaccagaggcactaatctactgaatagctatgtaggtaagacttataaaactttctttgcttttctgtagaacagaagccaagatattttatttatttatttattaattattgagacggagtcttgctctgtcacccaggctggagtgcagtggctcaatctcggcttactgcaacctctgcctcttgggttcaagcaattctcctgcctcagcctccctagtagctgggaccacaggcacgtgccaccacacccagctaattttttgtattttttgtagagacagggtttcacagtgttaggcaggatggtctcgatctcctgacctcgggatctgcccacttcggcctcccaaagtgctgggattacaggcgtgagccactgtgcccagccttcttttattttattttatatttttgataaggatatttgattctatttccatttgtgacattcattcagaataatattttctgagcaccatacactgtgcaaactgtgtgatcttggttaagtcatttaatctcactgggcttcaactgattcagtcctctaccttcattccttaactgcaaaatggactagagtaggggaactatgttccgaggaactgccttgggagttcgggtctagggggacgggaggaggctagatggaggcaacgtaccctggtgaagttggggcagctcctgctccaactactctcaacctccaccactccagcgcagctgcacttgtatttatcctatcagtctccagagcctcctcaacccagttgtctttcctcctcaactgtggtctttagtccctcttttaatttatcctttgatccttgtatgtcctagattcagaggatgatttctaaatttctatagccatagatggagcatattggtggtatattgcaccaga

SEQ ID NO: 136601 - DNA, 1135 bp, Homo sapiens
agttgggattataggcttgtgctacccatgcccggctaatttttgtgtttttagtagagatggggtttcacaatgttacccaggctggtctcaaactcttggcttcaagtgatctgcccaccttggcttcccaaagtggtgggaatacaggtgtgaagccattgcacctggctatatatggattttattagtgtgcctaaaattttactttcatgtatgtattttttctgtgactgcctcaattgctttgttctcctaatttttaaaaatctattgatttgagatgattacaaaagttcttgggttaaaaacatgtgattcaaaaatagattccctctttatttctttaatctatcttaatgtttaagaaaactgaggagctaatctgttttcccagtagaaattaagtaacatttacgttaattgtagtcatgcatacttacctgaaatttgtcattttaattttttttttaaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtaagtcttggggtacagtgattgtcaaaggtgtttttgtaggctgcctcttctaatttacatcaggggtga

SEQ ID NO: 136602 - DNA, 1983 bp, Homo sapiens
gtgtattaaaaaagaaaaaagttctggcctttgctgatattgctgataatgatgggaactttaggatacacttttatatctttgtgtacgttctattttattccttagaataaatttgtagaaatagaattgatagatcaaagggtgtacacatttacaagtttggttatgcttgaagtttggttaaattctcttggtattttgccttaatattcccttcaccaagttgatgagaatgttcatttccctacactggaaccaacacagagtattatttttctttttagttttcgccattctgatagggaaaaatacgttaccctgtttcaattttgaatttattttaggatgatgatccttgtatgtggaataagacttaagtgagggagagattagtggcagtgaactgttgaaatggttcatatataagatgatctgaagtacgttaataatagtaaaggggacagagaggtagctgcattcaagagagattaggaagaaaaatggatgagattcgatgatagataaaagaggctaggggtttgaggaagaaagataattcaaggatgaccctaagtgttctaccttgggagattggatgcctagtcatgccattacctgaaaggaggagtaggtttggtgggggaaggtgggggaagggggaagatttaggatctgttacagtttgaattgcttgttggtggatgtttcttctaggcagttgaaaatatgactttggtgcttttgagagagtttgttgctagaggaagaaatttaggacaacagaatgtaggcagtatcatatatggaaatggatggtagtctccagagcatgcttgtcgagtgagagtgtcaagtatggctcctttaggtatttaagaagtaggcagaaaagagtccttgaaaaatcaggaggttttgggaagagaaggaggagaaaaagtatttccaacactgttaaggatagagtttctacaagttatcagccactgaggagaaagcaggcttttttgtttggcatttaggaggtcattggtatctaaattagagtaggttcagtaaggcatgggctattggagaggagatggaagagatgagctgtgatggattgagaagttagtggaagtagagttaggtgaagcggtttggataaattgccattttggtcagcaaagggactaaagaggtgggagtatagcttttgatggttgcctggatggcgaaagtaagttgaacatgtttatagacttaagggaaaaaaaaaatcactggacagagagaacctgaagataaagaaaggatgggctagtggagcaggttccagagaaggggaagggactggggtccagggctgcaggagatggctgttaggtaagtcctggagagggaaagtgagtccccttctctgagacaggaagacagttaaggatgaggcccctttccagggacagaaggtaaaaggagtacttgaatgttgggagctattttgtctgtgaagcaggttcatctgcacatatggaaggactgcagaggctgggtggaaagctgaaggataatggcaaagggttgaaaagctttagtctttaggggatgggccagtgtaggaagccaagaatttatgagatagattgctgaaccgcattgaggggccagctgaggttaggagtctattttattttattttatttttgagatggagtctcactctgttgcccaggctggagtgcaatggcgccatcttggcttactgcaacctccgcctcccgggttcaagcgattctcatgccttggcctcccgagtagctgggattacaggcactcgccaccatgcccagctaatttttgtattgtttagtagagacggggtttcaccatgttgcctaggctggtcttgaactcctgacctcaggtgatcccacccgcctcggcctcccaaagtgctgggattacggacgtgagctaccacgcctggccgaaaatgct

SEQ ID NO: 136603 - DNA, 1077 bp, Homo sapiens
ttttctgtatcagtttattaaagattgcattagagggttcaacattaatgtcatcttacaatatacataaataagcttttgcttttttctcataaatgaccttcatttcaatttatgtaggaaaaagtataatttatcaacaagtgcatttttaagtgacttgtttggttttgaaactgaaggtatattaaaatgtagtttgttgattagtgatatcaaaaatagaccaaaacaacaactgctttcagtgacccagagtttgggaatcttgaactttgcatttgaaacaagctgattaaattttataatttttatgtttgtaaatgacaaaggtttggggctgccattttcaagcttttctttgcaagtaatttgggatgtggatggtcttgattctcagtaagtcagaagttaagttgacaaattgtcactgtatttttgctttttaatgttggcttttgagatattagattcatcttgatgttctgtgtaagaattttgattaggtaaacacagtttttggatctgatggagatcacgacagaactttgcagaagtatcatttcaaagacgtcagaatctgagttctgtcttggtataactggtgtaaattacacaagggatgactgtgaattttaaaagttatagtggtcagaaccaccaccacctagccttggttgcaatactgattatgcctgcctgagtcatgagcacattcatttgtttttcacgaaaagaaagcatgtttagatagttacactattttctgatttttcaaaaatcacagttgcctctaccaatttaaaccccatgctccatattccagaagttgacgagccctgattgggactaacgtagcttgagatctgaattgcgtgactccagataagttactcaacctctctaaacttcagtttgctttgctgtgaaatgtagagaatattgtaccacctgcctcacagggttgttgtaggtattaagtagtacttaccataatcacttagtaaatggtagctgcattattattactacatttaaaaatactcacctgtttacttgtccactttgccataagac

SEQ ID NO: 136604 - DNA, 2540 bp, Homo sapiens
gaatcttctagttgtctaggtaaaatccaattttatgtgaatcaagttagagattatatttgtaaaagaacttttgccgggcgcagtggctcacacctgtaacccagcactttgggaggctgaggtgggcagatcacgaggtcaggagatcgagatcatcctggctaaaatggtgaaaccctgtctctactaaaaatacaaaaaattagccgggcgtggtggtaggcgcctgtagtcccagctcctcgggaggctgaggcaggagaatggcttgaacctgggaggcggaggttgcagtcagtgagctgagatcgcgccactgcactccagcctgggtgacagtgagactccgtctcaaaaaaaaaaatttttttttttttttttgcgaatagtaacattttatttaaatatctgttactatttgtgatttatttccttcctttttagtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtaagaagaagtgtttagacattatacatcctcatccaaatgtttcagcctgattacttttgggttatttagattgagaacatttggagtctcttctgaagtaacttttatgtaagaattccggtgtagtaataccaaagtttgtaaaaagtaataagaaaattatgtaaaaagaaataggtggaaatgcagttttcaaataaattattgaagctgtcttcttccctgattgataggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaagtaagtaggtggcctttttgtgggagaaaattttatgtttctggagcttttaagtggccagtgtttgaaataagtagcattattttagagattattatgctactacattccaagggaaacatctttgactcttttatatatgcttatgatgttgctttaaaaccaagttatggtgaaagccaagaagtaaatgattcattcaacaaatatgtattgagtgcttactacgtgaaagctatgttctaggtatgtaatatttggaccatctttccattttgtctattaactgaattcaaataaaaacgtgtttcctgtgatctctgtaaacctggtcacagaagtttttgtaactttctacttagatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaagttgcccagcagctcttagcattgaagaagttggttcttaaacatgaatccatgattgaaaaatggtttctgtggtcttaggtttcagaagtctgaaataccagtatcctgtaaggattatttgaattgaattagagtataaagtctactttttgtctttatttttaacaggaatttccttcatgtgtatattatgtagaaggaagtactgcaagaagtacacaggctttcaggctgaaagttttcatcttgattatgtttggcccatgactttttcattttgggagacaacaagggagtccatggcgcaaaaatgctgacatgtgttttttagctttggaagctaggcgtttcctacggtctcgcgataataaatgtgctcataaaacccatgacctagaatggggaatttctgtcattcatgagtatcatggcttacttttcgttgttgtagttaatgaagaattcctaattctttaaaatttataatactgtataattttgttttttaatacacattgttaggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacaggtgagggcgcacgagttccatggcgcagcgtgctctgcgagctctcagaggaaactctagtatgtatccacaggggtgtcacaatggcattttagctgctagaccatatatagctttgtctattgaacttgaaaatataattttcagaattcagtgatattcatgaatgatttccttggataaaaagaaacaggacatggctgaaacatggatgagaaaaattgaaaacttggatgatttttatgtgtacatggaatgaaatccctcaaatatgttataagcattaactttttaaataaattaatacatttagagaatctatgtcagcataaagcaggcataatttacagagcagcaggataagtactttagttcata

SEQ ID NO: 136605 - DNA, 3835 bp, Homo sapiens
ttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcattt

SEQ ID NO: 136606 - DNA, 1031 bp, Homo sapiens
cctcttgagttctaaccacattgaagatagacaagaaaccaccaattaagtgtgcgatttattctagtaaggctggattgggagacccagaggctgagatgagtctgtttccaatctctttccctccaatgtaggccttgactgatgcagccagtcatttgaaggcatggggcctaccttccactcctttgtgagctatcaggagactagttctgtcatcagagaaagggagcatctactccagccctcccaggctagaacacaggaaaagggggagagttcccttacatcatcctaataaaggttagtccaattctggattgccctctgacattagcacactagcaacatgtgaggtttcgccattagccttgcatgtttgtgtccacttttattgatttttactgttcccccttgaagtggtggttgtggcagactttctaaagttcctttctctctcaaggcagtatgctttggtggttcttcagaaaattaatttttaaagggcaaatgtacttactatacaaagatggaaatcttgcaagttatttttattgcatgctttcgtaacaaaaattgggaaaatgatcacccacaaggccaccacctttattaaagggattgcttgtctttgttctcttctagtcttagtccatacacataaatcttttatctgtcttgtaaccacaatatcaattctattctgggttcagggattttctttttcaaacatcaaatgtaattcatgtgtctacaccagtatatgggagagttcgttcccctcaaccttacaaacagtgggtgttacagctaatctcacaggttaaaaaaagaatatgtcattgctgtttcaatttgctttgactggactcctagtggggtttaatacttgtatgtatataatagcactttaagttgtcgctctgataaactgcctattcaaatcctgtgccccattttctatttggagttctttgtacattaagcctattaactttccaatacatttgctgcacatttttgtagtccat

SEQ ID NO: 136607 - DNA, 1378 bp, Homo sapiens
tcctttgcagagaccattcggctgccttatgaagaaagggcattgctggactacttggatgcagaagaattaccccctgctttgggtgatgtcctggataaagcttcggttaacatttttcatagtgggtgtgtcatagtagaagttcgtgactacaggcagtccagtaatatgcaacctcctggttaccaaagcaggcatattcttctacgtccaaccatgcagactttagcccctgaggtgaagacgatgacaagagatggcgagaaatggagccaggaagacaaatttcctcttgagagtcaactgatcttagcgacagctgaaccactgtgtcttgatccttctgtagcagttgcctgcactgcaaacaggctgctgtacaacaagcaaaagatgaataccgacccgatggaacagtgcctccagaggtattcgtggccctctgtaaagccacagcaggagcagtctgactgtccacctcctcctgagctgagagtgtcgacttctggccaaaaagaagaaagaaaagtaggtcagccttgtgagctgaacattactaaagcgggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagaccctttcagacatgcatgggaagctggctgtcaggcctgggacaccaagccaaacatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggcccaggaatcggtgcagagcaaagtcaaaggtccaggcaagatgtcacacagctccagtggcccagccagtgtcagtcagctctcttcatggaaaacaccagaacagcctgatcctgtgtgggtccagtcttcagtatccgggaagggagagaaacatccacctccccgcacccaacttccctcaagctcaggaaagatttcctcaggtaacagttttcccccacaacaggcaggcagccctcttaagcgtccatttcctgctgctgctcctgctgtagctgctgctgctcctgctcctgctcctgctcctgctgctgctcctgctttagctgctgctgctgtggcggcggcggccggtggggcggcaccaagccattctcagaagccctctgtgcctcttattaaagctagcaggcgccgtccagctgccgggcgccccaccagat

SEQ ID NO: 136608 - DNA, 1032 bp, Homo sapiens
tcttccagggccataggcaaaacacaacactttcccaaatattctcccttccttgtttttgattcaagcaaaaacaacttacaagagaattgaacacttttgccattagtaaccaccagaaaacacattgagcttcaaattattcaataaattttgacagaaaaaagtcaattgtggttgtctctggttttcactgaaatgggagtggtctgtcttagaagtagaccccacccaaagaccagcctcacaacttcatatggccccttccatcagggagagagaggcccccacacctcccccttcatccccatccatggagatgtgggtcctttaggtgacccattaggagccattggtactgaatattccagaatgaaaaatcatgtttggcccacttggttatcttcatagttaaaaagggactatctaattaaatagtttctttttaattatgtctggcataatttataccattcaaaagtttcaaaaaataaagagtgaaaagtaaacttttgctgacaaagaactgttatcctccaaaatatacaaagaactcttaagactcaacaataaggaaatgaacaacctgattaaaatatgggcaaaagacttgaatggatacctcaccagaaaagatatacacatggcaaataaccatatgaaaagatgctcaacatgtatgtcatctgggaattgtaaattaaaacaaggaggcccagcaccagtggctcatgcatgtaatcagcactttgggaggcctagatgggcagatcacttgagcccaggagtccaagaccagcctgggcaacatggtaaaaccccttttttacaaaaaagcacaaaaattagctgggcatggtggcatgggcctgtggtcccagctacttgggagactgaggtgggaggatcgcctgagcctgggaggtcaaggctgcagtgagcagtgatcgtaccactgcactccagcctgggcaacacaccaagaccctgtctcaaacaaaaaacaaaacaaaaacaaagagataccactac

SEQ ID NO: 136609 - DNA, 1035 bp, Homo sapiens
tctgtaaagccacagcaggagcagtctgactgtccacctcctcctgagctgagagtgtcgacttctggccaaaaagaagaaagaaaagtaggtcagccttgtgagctgaacattgctaaagcaggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagacccttttggatttgcgttggaagctggctgtcaggcctgggacaccaagccaagcatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggcccaggaatcggtgcagagcaaagtcaaaggtccaggcaagatgtcacacagctccagtggcccagccagtgtcagtcagctctcttcatggaaaacaccagaacagcctgatcctgtgtgggtccagtcttcagtatcggggaagggagagaaacatccacctccccgcacccaacttccctcaagctcaggaaagatttcctcaggtaacagttttcccccacaacaggcaggcagccctcttaagcgtccattttctgctgctgctgctattgctgctgctgctgctgctgctgctgctgctgctgctgctgctgctgctgctgctcctgctcctgctctagctgctgctgctgctcctgctctagctgctgctgctgctcctgctctagctgctgctgctgctcctgctcctgctcctgccgctgctcctgctgtagctgctgctcctgctgctgctgcttctgcggcaccaagtcattctcagaagccctctgtgcctctcattcaagctagcaggccctgtccagctgcccagccccccacc

SEQ ID NO: 136610 - DNA, 2000 bp, Homo sapiens
ttggatagctgagatagttgtcactgaacagtcttaattttccctgtgacatttgtccccccccttcttcttgagtaggttagttgatgatttattgggttggatttattagttttatgacttttgttatctagtttattgtctgatttgactttaataattccttctggtctcaggtttattttgttcttttaaaaattaggtgctttctgttctcactcataagtgggagttgaacaatgagaacacatggacacggcaaggggaacatcacacaccagggcctgtcgggaggtgggggggctaggggagagatagcattaggagaaatacctaatgtagatgacaagttgatgggtgcagcaaaccaccatggcacgtgtatacctatgtaacaaacctgcacgttctgcacatgtaccccagaacttaaagtataataaaaaaaattaaatgctttcttctttgtcttgtttatttcaatgtttaaggttagttattcctctgagcactgctttagcagctgatgtgtgtatttggtcttttttctcttagctcttctgtgtcttcaggtttttattttcctatgaatgaagagttgtttggaggagttaaaaatttccagtgaaggtgcattctgcattttaattttatttatgtctagttttgttgcactgtgattacagaatgttgtctgaattattctctaatttattgatgttaactttgaagctcattatatggttgttttctgtgaatgttccttgggcagcgaaaagaaggttatactctcttctcaggttgcagagtgtgatatgtcagctctgcaatattatgttatttaggttttgtgtaactttactttttttatccacctgatttgtcatggatcaaacacaagagaagttaaagtctcctaataatgattctctttctccgtatagctcctattgtttttgctttatgactatcagtgttatgtttgatgcttattaactcacatcctcattgtgagatatacccattagcattagagtgctgcccttttactagttgaaggctttttggcctggattcgtccttatttgacattgagatctagttccctattttcttgtttacatttcctgggatagcattgccatccttttattttcagtttttctgaattacttcgctctaaatatgtctctaaatgtagtgtaaagttgggttttgctttgtgaatcagtctttttcatgtggtaagtttaacctatttatacttactggtatgatagatctgtcatctgtaatgataagcatttgtaattttctgttgctttctgtttttaatacctcagttttcctatgttatatatttgctttgttttgccatatttattttaataaataactaggcttgaatttttggttctagtggttatctttatagttattactttatttctatagacctttgtcccatatgggtcaccacttgtcagccaggagacctttgagcacttgaaatgtggctagtgtggccgaaaaactgaattgacttaatttaaatttaaaatggatacttgatgcagttaatttttacatctgtgtagaataacttggatatggaatccactttatcacctgtaaattttaggaaatctctttataggtcaattatttctgatagaaatttagcctctgaattgagatgtgctttcagtataaaatacacactggatttcaaagacttaatataaaaatagtaaaatatcagtacatcttatattgattgcatgttgaaatggtaatattttagatatgttgggttaaatggaatattatcaaaaactttatttcttttttatgttaatgtggctactaggaaattttaaattatatatatggcttacatatttctttctttcttttttttttttttttttttttttttgtgagacggagtttttgctcatgttgcccaggctggagtgcaatggtgcgatctgggctca

SEQ ID NO: 136611 - DNA, 1423 bp, Homo sapiens
ggtttcctttttatctagtgcacagtctgagttttcatatgctcagtgttacctatatcatttacggtgcttttatcatggtcagatttgtcacctatagcagagtttgtaagtagttattaaatctctctggaatctattgccattttctgatgagcctttgtagctaactcatttttaccctgttctgctgtcaagttgcccaacaattattaagacctcaagtttttctcttgaaacttggctgtttctcttttatcttggccgtttctctttgatcatatgctaagctctcagagtagtttgtatttgtggattctagtcaacatggcaacttttctgattttaactaaatatcacattttaactttgtaatttatgttgaaatttggtgagggcagttccttatttattactttacattttaaataattcttgcttttcttgtgtactaattcttcttgataaattagtcattgtgcaccttgaatagcatatcatcaaaagtgtgctaagggaactgtggatgggttacgtggtgttttagggtttacatctttgccatgtacttggcattgaaactggcattgaggccgggcatggtggctcatgcctgtaatctcagcactttgggaggacaaggtgggtgaatcacttgaggtcaggagttcgagaccagcctggccaacatggtgaaaccccatatctactaaaaaaaaatacaatacaatacaaaaaatcagctgggagtggtggctcatatctgtagtcccagctactcaggaggctgaggcaggagaatcgtttgaacctgggaggtggaggttgcagtgagccgagatcgtgccactgcactccagcctgggtgatagaatgagactctgtcacaaacaaacaaacaaaggaaaaactagcactgaagtatcttcagttagcctatttcgcttttatggcaggaaggctagtttacgctatacttgccttcgtgggagagctgggtttgattgtgacccatggtggatgtccttcatatccctcaaggagaaccccattcctggtcattgcctcatcttaactctgagattaaaccttttgccataatgaatggcagaaaaattgtagtaaactattacatttgcacaggtcagcatttatattcgctctaattgaatacttagggttctaactcagtggtatgttatttccctaagggtcacctaaacagttgtgattttattttcattcttggacttgatctatgattctccttaaccatttgagttgtaccagtgttgctttctctcttaccagggcatggaggtcagtatataatagtctcactgttgggaagaaattatcatctctctaacattttcccataccatgaagttaaatattttgccatgtgttgctggccagaaaa

SEQ ID NO: 136612 - DNA, 1016 bp, Homo sapiens
agattcaatagattcgactagcacttactgagtacttaccaactaaaacaggatatcatctaattctcacaacagccatgcccattttaccaattaggaaactgaagttctgagcgggtaagaagatgactcacacgtataataggtagtagagccacatgtctgcccgcctgatcgtcttaccacctctttatagcagagaaagtaggtgagggattgggcgcagtgtgtgagcaaaacaaactggaggaaaggaccatcgagtgcattgtcaccgcctcccaagcattaccacatcctgaagcacagccgtttccttctcgagtttgtttagtttttatcttccccatttaagatcatctgaaagtgaaagggaaaaaaagagctgacactgaaaagtctcttacagagtacaaagatgtttgtgatcagtttcccaagaggctgaaataaaactcaaaggtgaaaataaagacaacagtacatgggtaaataaaaaattggggatgcttaatagccattgtctgggcttgaggagttctttgatttgtttaccctcattgaattttctatgattagatgctagtccatggttctcagtcctggctgctcatgagaattgtctggggagcgcctgaaatgagtgacacctgctccctacataaaccaattaaatcaattgctgcgggtaggagtctaggtgctggtgcttttgggttacccaggcgattgtgtaataatattcttccagagttaaaaccacagtgttagagctggtgaaatttttgcccaagagctatgaaccactttaggggatagagtctgtgagtgagatgccaaaggttaacaccgaagtcattctggagtccatcagcattagttgaaagttctggatttggaatgaaatggaaactaagaagcattgggaaattgccaaggcatattcattgcctttgaggagctcatagataaatgagaagctgggacaaatacataaatttacgtatgctagtcag

SEQ ID NO: 136613 - DNA, 1012 bp, Homo sapiens
gaatgggttctcagggctgaccaagcagtaactgacagttcgattgtgtatcccatggcctcagactattctgtttgagcatcatcagcgtcattagtgattgctatttaattagcccctcttctaagttttaagaatatgtgactgttaaatattgtggtttattaagtttttatttatagagatgggggtcttgccacattgcccaggctggtctcgaactcctggcctcacatgatcttcccatctcagcctcccaagtagctaggattacgggcgtgagccactgcctctggtttaaatgttaagcacatgttaaccctcaccaaatctctgtgaagtagatactgctctttttttataggtggttacaatgaagtttagaagtgtaaagaaacttacccctgctcatgaagcttgtgaatgctctagtcaagattcaaaccctgacctttgtcatcgaacttcagcacctgacctttgtcatcaacgccccgcaggaccataagcttttctctgaatcctgaactcaaaaaactctgaaaattgaatttctttttcatatatttgctgccacaactcattttgtggcaaaaccagacctgaactgacttgattccatagtccttatcctacttactggaaatgttcacgtatttcactgcagctatgttgtggctctctaatactctgtattgtacaatgtatggtatagactcctttttaccttcctaaaattgaaaaacctttaaattctgaaaccatctagatctgcaacttctagagaagagatgagaagctgactatggccacctcacacctgccagccagctctcactgctcacaacatgctcgtatcctgtgactcctaacaggctgccaacttggaaatttaaacatgtatactttcattaccctcaaaaactcataattgtgaaaaaattattagttcatactgatactaccagtttcagtttaacaccagaattcttctacttcttccctattccag

SEQ ID NO: 136614 - DNA, 1006 bp, Homo sapiens
gtggctcacacctgtaatcccaacagtttgggaggccgaggtgggcggatcacctgaggtcaggagttcaagaccagcctggccaacatggtgaaaccctatctctttgtaaaaatacaaaaattagccgggcatggtggcggatgcctttaatcccagctactccagaggctgaggcagggagaattgcttgaactcgggaggtggaggttgggtgacagagcgagaccctgtctcaaaaaaaaaaaaaaagaaaaaagaaaaaaaaattatctgatacttgttaaagatggtagggaaggctttattcaagagggaccactacagtgggagttttgcaatagtggggagagatcaggttgaactcctaatgcaacaaggacaagtggaaatttatagccaaggagcagagtgtgggtcaatgggtggaaagttactaagaggaaaaatccaggttggaggggattcttgttgaaggcaggccagcatgataagatatcgagggtagggggatcagacaccaagggtaggggattttcactaaaatgactcagcaggatttttgctgagactggactaagcaggtcaagatagaacccaaagtcgaggcctagtcagaaagaggactcagagccgggcacggtggctcatgcctgtaatcccagcactttgggaggctgagacgggaggatcgcttgagcccaggagttcgagaccagcctgggcaacatggcgaaaccccctctttactaaaaatacaaaaattagccagctgtcccacctacctgggaggctgaggtggcaggatcacttgagcccaggaggttgaggtggtagtaaaccgtgattgtaccactgcactgcagcctgggtgacagagtgagaccctgtctccaaaagcaaacaaacccagaagaaccggtttcaagtttggtcaaaggagagagtctttgtcatcccacagtgagaacatcaatgtttcttttgtgatttaaagataatttcc

SEQ ID NO: 136615 - DNA, 1023 bp, Homo sapiens
tcctggaaagccctatgaatgggagtggatttacacgttctgttacctttgtacttggcagttttcccatggtgtttatttgaaaacaagttcagattatatcccaggtcacttttgtattgccgctggtaacactaggaacgtttttgtgttaagaaaaaaaaactgctttcaaagttgcctcttgtaatgaatgttctttttctctgctaattaacttattttcttgaacttgctatttcaaaggataaaaattcaactagagactgcaggattatttaattttctctttccaaccagtagtaaccgtgctaccgtgggagcactttatttctccatctgttagactataaaatcatggaacatttttcatgtcttaatagggagagataatgcatgtgagaaaacttcatatatgtttctacgaaaggaacttcctgtgcggctggctaacacaatgagagaagttaatcttctgccggataatttacttaaccgcccttcagtgggattggttcagagttggtaagtaaacaatgtggcttaaaatggatcttcccacaatgctgtgaacatttggcagcgagaccattctctgtaaaagtgcacatactgcccgtctaggtaggaatgagtcatttgggatagctgggttttccatgcaattaaaagttgttttgttttttttcttttagagctgtttgttttaaagttgttttagtgaaaatgcttgttaagttatactagacactttcctgagtttttcttgtgtgtggtgggattgcagttcttctgacaggatatttgctgcttttatcaagtcttaaccttactcctttcgttttccttgtaaagacattccttgaagtcagtacttcttgtagaacaaattaagtcatttaaaggggaacctcagattggaaaaatatcagttccctcctttgcttcatttgctccatgaaaagtaggaaaaattttgacagagtataacataaacttaaatcagttatagctctgatgctt

SEQ ID NO: 136616 - DNA, 2912 bp, Homo sapiens
tatatgtgtaacagtcatttttagttactagagtgtcctcatcctctatccaaaggtgtagataataggattagtggcaattaaagcttagaaataattagaataaagggataattctttcaggacatgttaaaaccccaaatagagatcacatatctctaattggaatatctgaatccccaccagatccaacagatcctggctggatatagctgctgcactaatgggcctctctggatctcatttttctgtgttctccagattttaatgttggacagactgtttcttatactggccctgattgagatatggagctattcttaatccagaagctgtttctgagggtttaattggccttctttctcccccattaagtactgatgaaattaatttaactcagaaggacccttcttcacttctagtttctaagttcttggcaggcacttcagtgtcacacatgtgtttcttaaaatgtataagtacatttttggtaatcaaactgtagacttggtatataagttaggatatgtctgtttgtaagtagaaaaaatgcaaccgaacctggctcatgtcactagaaggtccagccgtagggtgagcttttggtgttggtttgattcagagattcatgaagctatcgaggccctgctttcgatggtgctggcttcattttcagactggattcccccctggtggcagaatagctgcagcagttccaggcttccaatccacacagcactgcacaaaagcagagcaggttgatttctctgccaaagtcctctagcgagtcttttctgtcattttactggcctgaattgagacagtatgtccattcctgagccattccctgtgttcaggggaatgcacacagtgataggcttagacctaaactattgggctaatgaataattagtgacaagagaaatagaattgcccagagaaaaatgggaccacccaggatctttggaggcactggcttccctgatgcacttaagccacatgggggatgcggatgggatggagacctgagtgaaattttggagtgttcttaggaagagggagaggaggggtggatgctgggcaggcaactaacatagtaactcttctttttcttttttttttttccttttaggtatatgcagagttttcttgaacttttagaatatgaaaataagagccctgaggatccacaggtcttggataagtaagtatggtaccacttagctgaaagtaaaaatatctaggtaagaaagattttggtaaatgtaattcaagtcattaagactcaaggagtatgaatgtggacaaaagcgttcattttcttaatgagtagtgactcaacattgagttttttttttttaattcgagctaagaatgtaacacaatacaaaagtaataatgacactttcagttttgcttttatgatctaatacttaatacctttacccaaggtgaactgggcagtcactataaacactgcagtaaatgttccatctagtggtagttttaagaatgcagtggcctttttatatacatgaatttatctactcaatcctttacaattaaaaaaaaaatttcaataggatattacatttgagctcaaaaactgtagtggttttattttggagaggcataaaagtatgtttttttatatagcaacctgaattctattgctccctttatgcacagactggcaaattatcatgctgatgagattcatttttatttatcccaggaacactaactctagctgtgagtatgttttcccctccaagagaaattaaatatccctttcacattaatttcttcctgtttcatgtatatgtaagtggatgcatatggtaggcctgttgtgctgagaaatttctaagtataaactagtccacatagttatgagactgaacacctgacttaatagatgttccataagaagaactagggaaacaccatgttatacaagcaaccttaggaggtatttaacccagtcctctcaatccacagataaggaaactgagttcagagatgtgaagtgacttgcccaagattgtgaccgttcatagcaaagctggacctataagctatgtttacgtctgagccatgagtagctagttctagtctagttgtaaactaaaattcaaaggaaaaacaaaagccctcacctattttatactttgttgggtgtttgtctgatggatctgtgaagtgtggaaggcagggaagcattgggttagagccccagatgtagcgttttccttgatataagccactgctgtcatttaagcgattattaaatgaattcaatccaggagctttgttttctcaaaagtcattagctggtaaccgtttggcagaaatcctaaaacctagggctgaccactgtagctccaaattttagaacaaatttgtagaagtatagttggtcctttgtactggcagtttccacatccttggattcaaccagccacagattgaaaagatattcaggaaaaaaaaaagcaataaaaaataacaatgcaacaataagaaataatacaaaattttaaaatacagtctatcaactgtttacatagcatttacattgtatcaggtattataactagtctagagatgatttaaagtatccgagaggatgtgagtaggctgtatgcactattttagataagggacttgagcatctgaggatttgggtatctgcggggatcctggaaccagtcccctgcggatactgagagacgactatacacgatgttaaatttctgctgtgtttttcccggagtcccgtctcagtttctggaacaggttatccgatgtgatttatggccacgagcctgctttgcaaactgtcagtgctgaatccagtgtgtgcttgacgatagcaataatagctgagctctcactccgtgagttttgta

SEQ ID NO: 136617 - DNA, 2849 bp, Homo sapiens
tagttttaaaaacattgacactggaaatattgaattggatgttggtgataggagccatcagttctttatttcacagtgatcagtgaagtcagattaagccagactgtcagtccataatcccgtattgagagttttagtctgctcttgagggtactaagcagatatgaaaaaaacaactaaaattccctccacacaaaaaactttttggctcatcttcagcactgtctctttggctgattttataatccttgaggaaaagcatccacatgtctagagcataattcaccctgtttgctgcatcacaaagtggacaaaccatctttattttagtaatttgatttatttggataactgaatgttatagaactattaaatgtggccttatattaaatgtatatcttcaaaatggaaatgtatgacaatttacaggaataaaagagcctaaatactgttcaactaaactacttagataactccagttgctttctgatctaaatacacatgtacacatatatacgtgcatgtttttagatcattagttaggcctacacatctctgtttttcttccccttaatcagttcgaactttattaattagcctaatgcctgtatttatcatttttcatagtttaaaatatcccctattttatttaggcatccttcttttgttagtcgcaatttttgcttgatttaaaaataagaacacctataaatatttggatgcagattgcttttttctttggggcttcttttggcttttattcagaaacaaaattttgcaaatcttgtatattgtgaaattatctgagtgtatttttaaaaatacttgaacaagtattgtttgtgtacacaacattgaaacataatctccatgggggaggcatctgaaatgctgccagcgaagacactttgcaagcttgtccaaatggtatagaccacatgttctaaatatttaatgaaagttggagtttgtgtctggagtagtactaagaaggtgggtatacttgactaaggatgaaagtaagtttcttcatccatgtcacattgggagaggaagaacggattgggcacctggcacgtgtcactgctttagaacctgctgactgcaactgacagaccttaaaccacatcctcctccttcattgaccaataagagttgttcacccatcaattgtgtgtattccattgctctaagttgctgtggatgctaaaatgatttttacacataagatatcctttctaaacataagcccctatatttccctgtgtgaccatcccagcctgctgtgttttaatcccctccctttccttttgtgttcgtctagcacttctgtttgggggtgacactaatcctgttcatcctaaacacataggaagtatcgatcccacctgtaacgtggcggatgtggtgaaaggtaaggagaccgttgtaatggtatcgatcgtagttcaaattggattgtggtttattggaggcagcttggctatagggttattttgcagtgcagtctgctgattcatcaggtcactctgggcccaagccactggatccagatgaaatgttctttctaggcagttcaggtaggcagttctttctaggcagttcagcataattggtaaggctcaaaatgtgagtttctactttattgattagagtttcatttgtagttctgtctcaaacagtaaacatttaagtaagattctgattgccactgttatctgaaaatttcagagaatccaaattcttatcataaaattaggttgaattcacgtgtctataaaatttaaacatatttctgttgttcacatctggctttagaatttatgtggcatgtaagcttcatgggttcattggactttaagctagacattgttccagtatcctccgggaagaaccaagccctatatccgtaagtccctggtacccaggcactttgaatttgaacagcagtttcctcattatttattcatttaagatcaatgctatctccaagaaaccttcctggttgtgagcgatccaccaggtacctcttcagttttcttcattgttacggttactttgtgcaacctcagatccccaaattgtccctttctgcagattgtatctcctgtgttggcctttatctcccttctttaaacgctcacctcccaagtttcatggctgcaattctctctgatcttcatcaaggatcttcattgctcttcagcagccatagcaaaggaaaacctctgtaatttgtttaccctgggcattcctaaacccagggaggaggaccagacctgttggttttagcttagcctaggattgtctggctgccctggcctctgttgagtcacaacagatttactcacattatttcagttgtaaggtgaatcagcccagcctcagctctaggaatcctattggttgctctctcacaagataactttgtggttgatcagaacctccaaaggcctccgggggcaaggaggaaagggtcagtcttatcatagcttacatgttcattaggccttagctcagtgccttttatgaaacagaaaacttggttcagacagttgattacccctttgagaaaaaggcacaatttagaaagcaaaagtgcattgtgatatatggtatgtgtgcattttctcttgaactgtaaccaatttgaggtcagggtttgtgtcttatatttgttttataacttgcatagaaccaactgtagtgcttgtgtaggtgattaataaatattccttggtttgatacattttaaatcttttgagaatatacttttaaaaacagctttattgagatacaatctcatatgataaacttcaaccatttaaaatgctcaattcagtgttttt

SEQ ID NO: 136618 - DNA, 1045 bp, Homo sapiens
caggctgtacaagaggcatggcttgggagtcctcaggaaacttacaatcatggcagaagggtgaaggggaagtaagcacgtcttcacttgatggcaggagagagacagcgaaggggaatgtgctacagacttttaaacaaccagatctcgtgggaactcactatcatgagaacagcaaggggaaaatctgcccccatgatccaatcacctcccacaaggccccaccgccaacactcaggatcactattcaacatgagatttgggtgagggtgcagagccaaaccgtatcaatgaagttttaaaaacacttgttttcatcatcttattgtttctgcacaaataaagtctttcactaatttttagggagcttttaaccaagaaccagtacaactagataagtagcagggagttttatgaaactgttaccacttctatagaacagagcgattaagtggtgctaaagtgagtcagaggtgtcagagtgtgaggaggaatcgactgtgatttgactcttaatgtgaacagaatcgatcgttttatggcacttactgtctgtgttactcttctctcatatttagtacatattacctggccttgtcattatttgtactttcttttttttttggagatggagtctcgctctgtcgtccaggctggagtgcaatggcgtgatctcggctcactgcaacctctgcctcctgggttcaagcaattctcctgcctcagcctcccaaatagctgggattacaggcacccaccatcatgcccggctaatttttgtatttttgtagagatgaggccatttgaccagatgttggccatgctggtcttgaactcctgacctcaggtgatccgcccgccttggcctcccaaagtgctgggattacaggcatgagccaccatccccagcctatttgtctctctctatctagggtgtcaatttctaaaggtctggaattattcttatacgcttttgcatcactcctcttagggtcagaagttttgtaccaaaaagtagctgaaggttatatgaagaatagttcaa

SEQ ID NO: 136619 - DNA, 1008 bp, Homo sapiens
tgcactgtggccagggccaaaaagtgcagaaggtgaatatagcccatcaaccttaccttcatcttcagatacttgcaaaatagatctcggattcaggtatggctctatgagcaagtgaatatgctgatagagggccgtgtcattggttttgacgagtctgtgaacctcatatcagatgatgcagaagcgattcattgtgaaacaaagccaagaaaacccctgggccagatcgtgctaaaggagatcatattctgccacaaaatgtctctaaccagaaatgatcaaggaagtgagacactattgagaacttgtttttttaggtgtcatttgttgggagtatagttctaaaatgcctgttcagattgtttccattatctgtatatattattaccagatgacagtaaatgctgtgggattgtttttattaaaaaataaaataaaaacaattaaaaacagcccatcagcacttttctaatgttttctggtcatttacatttacctttttgtgacactggcttcttaaacttcagctttatgattttctgtattctgttagactcaaagttagggaccttggcaccttccttttaattttttcagcactcactcaaattcatcctagtccagcctctcatattttttgtctcaaatgattgcatgcattcaagatagaggctaatatttgatagcagagttctgtggtgaattttgaataggaaaatctgatgaaacaacctccattatctgttcaattttcctgtgtgctatttcttaaaacggattcatggctagtttggttctgttgggctgattgctgtgtgaaccttcaccctgttctcagccttttaaaattttagtctaatgcatttacagtttagatattttaacctggggaagtatgtatgagccacacctgcagttttgttaattactttataatcagtaccttaaaacccttgaaaacagattcctaaaagaaggcatgtcacttatattcagtggcaataa

SEQ ID NO: 136620 - DNA, 1034 bp, Homo sapiens
taaacgggcattaatcccatccataagggctctgccctcataacctaatcacctctcacaggccccatctcctaataccatcacatcaagggttacatttcaacataggaatttgggggagacacacacaaacattccgtccataagaggcatgaatcccaacttttgaaagagggtcactagatggaagtatgctgattggtgggacagagcagaagcagccacaggggaggaggctgcagcagaggtggcaactggtttgccgaagattgtcctggagggactctgggggcagggccaggtggtgcaatggactggaatgggaagggaaggcagagggtagggttaactgaaagctggtctaagaaagagcatggagggatgacgggaggcagctgtactctggccgggttcagcctgccaacaggcaactaagtattttgttcgagaacaacctaggaagaattagggcttttcatgtgagtgttgttaccctgcagcaaagccctgttcgtttaagcatttgggggcctctctgctcagaggcccatttactacctgctcatcctcaagccaagttgaaaagtcttgaccagtccagagagctctaagtcaggcttcccacttaatggagagccccagggggatatgaacgccagctccctcatacagtgaatccggttcttcattctcaaacaagaatattgcaaccaagatggatcagaccttcagcaaaagccagcagcaagaaccaaacctaactggcattaaacttatcagctctactgttactgccagaaaccccccttttgaaattctgagagaaaatcatttcaaacctagaattctctatctagccaaacctttaatcaaatagatcagaggtgtaaagattgacagatgtgtctcccatgcatccctttctgaggtaggttacctgactgccttgatgttatgtataatatgcatctaagaaaggggaaaacattctagaacttcaatcaaaaacaactttaggatgatggctatgcagc

SEQ ID NO: 136621 - DNA, 1062 bp, Homo sapiens
ctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgttatcttagaatttttcacccaactgcttggtttcaaagatcttaagtgaaaaactgcctcctggtcaataccaaatttgtacagagtgtgaagtggagtttttatgcttctgtcaaacttccatccatctaatactgtacctgtgtcatattttattcctttgtagtcttctaaggaattggaagtttctgtatgatgcgctttactagttgtaaaatagactatcagagggaaaaggcctctctagtttatttttgaaaaatgctccaggtcttaataattttcattttcattcatcttagttttagaattgtcacctcagtctgattttcacaatcctttttgctaaaagttggaagtgggaattagcagacgatttgggataaggaaagaggaatgatgttatatttacccttaggaatagaagtgaccgaagaatccggattgaaaccagcatcctatatacagctccacagg

SEQ ID NO: 136622 - DNA, 1045 bp, Homo sapiens
actgcaacctccgcctcccaggttcaagcaattcttgtgcctcagcctcccgaatagctgggattacaggcatgcaccaccacgcccagctagtttttgtatttttttgtagagacggggtttcaccatgttggccaggctggtctcgaactcctgacctcaagtgacctacccacctcagcctcccatagtgctgggattacaggttcgagccactgcgcccagccgaccctagcttccttataaacatgagataatatcttcctaggcctcaatttccaacgatactcctttatgctttcaagtgtgatacactgtaggagagaggaggcagcagtttagggggtgctgcctactgcctgactctgacagcgtttctcttgtttgaggaaggcccatcgatcaccacatcctcacaagcagtaccatgtaaggggccgaatatggataatatggtgtagaaaaatctcatcacattcttccctttacaagtgtttttcaaaagtaaagattgatttcagtgtcttcatgacttaatcggtagttctttactagcacgctttttggcttactcacatccatctgaccccagtacaaccttgcttctcctgtctttgttttcttcattaagaatttatctttaaccctaaagcaactgcaagaagagtttcaggaacatctgtgttcttctggcttactagcctctttacccaagtattcatttatcctgtttgtcaactgtacatgattcttttaatttaggcagagaatctggctgtttactgggtttgcctataagcaaatggtcagatttcccccatataggttgtaacacaaatagacatggaccctttttcagctaaattctttcccattcctctgtactgctctttcatttactctattttattttaagtggggactgtgtctatttaaaatagtgcctgacacatagtaggtgcttaataaacaatgttaataaataatattaaaataatgaataatattcataaatagtaggtgaatcaaagatagaaaactgtca

SEQ ID NO: 136623 - DNA, 1045 bp, Homo sapiens
gaagtggaagccacattacaaggaacaagccctagaatcaacagtacagaaaactgagtcagtcagtgaaatggaggataagacttgagaaaaaaatcatacagcatgaatgaagaaagatgagatgagtgccatctaaggaaagataactgtgaaggacagatgacagagagccaatataaaaatgaagttttcaagaagagaacagactaaactgatacaaaacgcagtgaggcttgaaatgaccatatctaatgctcactgcattccagaaaaaggcaacagacaacagtcaatcctgagatatactccaacgaagttactaaatttcaaggataaacaaagaattcaagtatccagggcaaacaatcaggtcatctacaaaaggggaagaaaaatccatcaggactcagacctgtcagcaccaccagatatggacaaccataaagtagcaataacatcctgtctccagagaattcaaggaaaaaggctgtgatccaagaatccgatagccagccaagttattgttcgtaagtaacagcaacaggaatacatttgtaaatatgcaagaaaacccaaccgaagctgtaatccagtctgcaaaaaagataaaaacatcagctctcaaatgtggagtctttgtatgaaagggctggcagtaagcactgaattcattcagacacagaattaagtctaaataactctagtaattacctacagctatccactttaagttgcctgtcatttttggtaaaagctgccaaatccatctgattatctcctctaactatgccaaaatggaaacacacaaaagaaaccctctcctgaacggaattaacttgctctacagataatttggggtttagagcttaccctttgaggaatagtatactgaagaaattcctcaaaagagataatacaaatcacctggcgtactgttccaagcacccaagtgcttgctttggcccttccattgacttaccatgccaccttggcaaactccttaattgctttgggattcatacaaaaaaccgatatacctgtg

SEQ ID NO: 136624 - DNA, 2230 bp, Homo sapiens
gcactggttttaactactctttagttcatctttgccttccaaattggttgaaaatggcaagcttagaatggaatgcatattaataacagaaccacttaatgttttaaaatattcataccttgagattctttttgagagaaaaaagaaatcttaacatccaattctagttgttttggcttttcacatatgctagacatgaaaaaggcagttacaaaagtgaaatccgattggaagtcagtggtgtccgccattgagccgtgctaaatgtcgtgtcacaaaaggagtttgtgaaaacaggatgagtagaaaatgttatactgttgtttctatcgtggcaccgctttcttataaattccatttgctttttgtcatctgaactgttacaaccatgggaaacctcagtccatatttttaaaagcactatatacttacaggaaaaaccgacttatgccttcattgaaaaaatgttgaagttaatatcccaaatgtttaatgagcatgttttagaatatttacagctaaagtctgtcactttagggatttgacaaaacttgagactgcctgccaccgaagagggaccaggcagaatcttctcagccttgtaaccagcgttaaaaaaatataaggggcttgatgagatcctagatctgctccttttctcctaggtgcctgggtaactcctggggaaagcatcatattaagtccttttcaagcaaggtgtgtgattttgaccaatgaattgagctgatatgtgattttgaccaatgaattgtgcatctatttaaaaattaccaagtgtatcttgactcttgagtggacagtcaaggcaaagtttacttaggaaatgtaaagtatggagtgttttaaaaaattcaaattgagtttattcactgttggaggaattgaattctattgcctccctcatttccattatgttcattgttacaattgtgctgctctgttctcattgtgatgcttagttctcgtgtagaactgagtgctacattgtgattagaaactggagttgtgcttgagtcagtcctggaaaacaggacccatttttaagaagaacggaacataccactttggcattctggctgaccctaatttctgcagagttccttggtgttaaaatcatttgaggtcatagttgctgcttatggtttatatacacaccatctgctgctctaagttcacatcctctcaaaagcatgcaagtgcttgaaatttaaatatttcccagatctaaaacaacttgtgactacctaagaaatgcttgaaccaaataagaaacagcactgtggaataaaatataccattgtgaacatatctgatgctgcaatgaaatgtaaagttccttactttgctgatttttcatcataactccttgactcataaaagcggtgtctaaactgggaacagctgctaatagggtaaaagtattatacatcaaataaaagttcattacaatatttgtactcataagtcaaaatctgacctggttcgctttgtgcctctgtcagcctacttacagtgataaatgtacacacaagtccagtgttgccaaggagctttgtttatagaaagaagcttggtcccctcagttctatgctgttgtgtggcctggttggtacatgccgtcatgatgaaggatgactttggtttgagataatttgtcactccacattccatggagaaaagtgtttcattttgatgttggaaaaacatgaccagagaagcatgtgactcagataatgttccccggaagttgcagagcaatctgtggtgtctgtcatagcccaactagtcctggagcacatggacaattctgtaccccaataatcagaacaataaaatggtagttgtgattcactgtgcgtcactgtggtgttttgtgagccctcgtctatttctcatcactcccacctataaacttctctctcttggtttctgaaattcagtacattaacggcaccaagcacctttgcaaattgctgggaatagacaaggatgcttgcttaaagtcttatgattgagtgaaggaaaataggttatttggagtccctagcagggaacatggagctcaccttttttggggagcatcctatgggtgaaatatagtagctgtataatagtaaactgttagagttggtatttttcaaaatatggtccatggatagaagaaagagggccatacactgtactgtctaagtcaggacacttttgagaa

SEQ ID NO: 136625 - DNA, 1158 bp, Homo sapiens
agtcacactgaacgacttgcttctggcaagcatgctcctgtgtgtcaggaccttaccaaggcaaagaaatgccaggctcaagaggagcaggacgtgagacattggcctggcttctaacctggtctgagtggaagagacacagcttagggatttcagttttgctcttaggctactagatactgttatttcaccccctgagggagggacaggaagagcacggatttattttctctccgtcttcagtacttattttagcatctagtcataccccagggagagatgcgagacggtgtcactggctcagctgaagcagatgagcccgtctctagcagagatgtgcctgtttcttaggcatccgttcagcactagtcttggccatcagatttttaaaaaagaaatagctcatgaggcatttgcaacttctcctctctagacttctttctagttttcctctgttgtgtcactgcgatgtgtccagggacaaagccataagtagagcatacatacttaagactatgctgtacatataagacaagacctgtctgggttaaagcacgaccttatgcccaagcatttactctggtgctgaataacgcgaactactggaatcagcctcccccaactctgcgcgccccctgcccccctgctcctatcccattcttgctctcaaatggaccacaccattctcaactcgtttataaataaagggatgcagaattgcactttcgtgtgtcattgtcatgtttcttaagtgtgctgctgtgtgttcctatttatgaactagctcaatggggaaaaatacaggcattgcagcagctgtcctggcccaccggctggctctgcccagctgtggccccagcccttcagaaggatgtgactgtgcaccgtgcagagcagggcaaagccttggagttgccaaaggccccacatttgacttgaaagctagttaggaacagcaccacgtggagggaagctcacatggtgaacccagtcaggaccctgcattgtaggctccactactaactgactttgtgaccttggcctaaccttttcacttctttggcctcaaggaaattatttctaaggtctcctttgcctgtaaaggtctctgaatgtatgaggcaggctgcattgccccaagcttctaccagctgtgat

SEQ ID NO: 136626 - DNA, 1004 bp, Homo sapiens
gagtgctgtctgctgtgaagcaaaactatgaggctgagctggcttggaacctctttgttcttggcactttccttctccaggactctgggaagcactcatatgggacagagggctggcaggaacatggcatgtgaagaagaaaacttctttttgcagtcaagggccacccagaatattgctcttcagagagggacaagggcctcattcttccatttggtctctgtcttccatcatgcactcaggtcaagccatgcaagtctgcctaccatttgagttagttggcacttgtagcagtgaaggatgaggccagccaggcaagggaaggtggcgggaacaagggaagagaaaaggaggaaagaagttcctggagggaggaaaggaggataaagaaaatctgctctcataaaaccatttcaggacctcactttacaggtgagactctcttgggaaggcctttgtgcccctgctccatggcccagggcagatagattcacttttacctgaatcttatactctggagcaaatagtgtatcaggctgactatacatttgcaggccttacacgccatactgacaggtgccacttacgtgactcatcagataatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaacttttgatactttttggccatctctcagtctctcccagcccctacccccacaccacctccctgctcccaggcagagaccgggttgcactttgttagggccagcaggtcaactgtaatggccaagagtgagttaaggctggaatgagaaatatgccccaagcttggaggggtaagcaggaataacacaaagcaaggaaagagattctttttgccctagtgaggaaag

SEQ ID NO: 136627 - DNA, 1048 bp, Homo sapiens
acacagagttacttttgccacgttcatttggtacaagcaagtcactgaggccagcccagattccaggggaagggaattgggccatctttaatgcaccacaatgccctttccaaattgaatagtcaggtagcattttacttgccctagtagcacaggctaagactcgatgtaacttttcctatgtgcaaggacccttccttgtgctccatcaaatctgctctgctgattccttagcaggagggagaatcacagtaatgatctatttgggacccaggtagagaaggccagaattcatcatgggagaaagatgctcagaaatggcctcagcatccatatttggctttcatactcaaatcatggcttattttgaaagtcaaaagtctctttaaatgaaaccagagatatcaagggcatgacttaagctttacaacactctgctctgcttgtcagaactatgtgtcaaaatcctctagcaaagctggatgaaaagatggagcttaaattaaatagactgtaaggtccacattactcatcaccattctaatattgcctactactgttgaaagtttccttcattaacatgtgctttgctgcttcttaaaatagctccataaccaaatgccgcaattctgaaaagcatgataaaaaaggttctctgatcatgctcattaccgaatatttttagcagagcaataattaggatttgaaggaagccgggtatctcattatgtcaacagaggacttggcttctttcagagacctacctcccaaccagccaaagcaaatctctccctaagccaaatctactttcagttactcaaacacagagacttcaccttctggcttcaaagaaagggtaagctcatggcatcaatgtcttacatgacttgctaaaatccattagtcactagagaatcgtcttattatttcagcaggaggggtgtgggtaaaatatctgcctgctgaaagatgggatggatttctcaccagaatgttccccactgttcccacaaaggtggggatgtcgtctgagggttcccccacccac

SEQ ID NO: 136628 - DNA, 1043 bp, Homo sapiens
ccatgcacacctctgtctactctgtcctcttgaatgatttgaaacaaaatcccagacttcctagaattctgtgtatatgtctgaaaaataagagctctggttttattaaacataaccactgtatcatgatcttacctgaaaaaacaataattccttgatatcaccaaatattcagtgttccaatttctaattatcttatgtcatcatttatatatagcttgtttgaacccaataatgtccatactttacagtaggttgatatgtttttaaaatctctttcaatctgcagatccccctttcatttctctttttctttctctctctctcttttttgccttgaagtttatttgttgaagagatgaaagatcagggtccttttttggcagggaggggagtcctggagaatttcccacagtctggaaattgctgacacaccacaatttttaaaagtgagcttattgcaaaatcaactttgtaaatactcttcagatttactaaatggcctttttctcagtaattacgtcttctttctttacttttctttcctccctgcttcctgaattcatttctcttgatcacctctgaatcaataacaaaaagttttacaaaactgccatctgctttcccctggggtttatatcttaaaacaaattttcctcaattgaattcacattgaataagaacattgaaagcaaggctccctcattagacagtttgttatttcaaagcattttctatttactgtgccttatttagaatacagtataatcctatgaaggcaattctgtttgttcaaatttgtgtataattggaaataattgcaattccctatctgacataaagtctctcaactttttttattagagaaatttaatttattagaaacattgtatcatctgaatctattaatgtaacatttctttatgttccaaattaatgaggttgcattgcatcaagaaataatcacaattttaaatctaagtcttaaagatcatttaacagaagttggcattgatttcttttttaaatttatttttataaca

SEQ ID NO: 136629 - DNA, 1052 bp, Homo sapiens
agattgacaaatatatttattttattattgagtttaaagtctgtatttgtctttatcaattatcattctcactcctgtgactttaaattcccccattcagcaaatattcttaaggaccttctatatgccaggtactgccctggggaatagggatatagcaatgagtagacagaccaagtccttgctttcttagagcttccctaatagcagggagagacggagcttaaatatacaatgtttcctcatctgatgacctggacctctcttctacctgcatccatgccctgagctgaatgagtgaatctagtctaatggctttatatatcacatactctctcagtttctaaacctgcatctctagcttagtcctttctcccaaacaccagacttatacatccaactgtctacctgacatctccacttggagatctaataggtgtgtcaaaccaaatctgtgagaatggaattgttaatttccccatccttgttgtccctcccacccctagacctactcttccagtgttttacccctcctagggaatggcaatgccatccttccagttcttcaggccagtagctttggaattatcctgattcctctcattctttcacaccctacatccaatctgtttcaagttttatggatccaaaatctatccagaatctgaccacttcttaccacctccgctgcgatcaccctgacccctgcctctgtcttcttttgcctgattattacaccagacacctcagtggttttcttgtttctacctttgacctcttacagtttattctcaacacattagccagatggtcttgttaaagctaagtcagatcattatcatgccttgttcaaaacgctctgatgcccagcactttggaaggctgaagcaggtagatcacctgaggtcaggcgttcgagaccagcatggcgaaaccctgtctctacttaaaatacaaaaattaggcaggtgtggtggcacacgcctgtagtcccagctagttgggaggctgaggcaggagaatctcttgaacccaggaggcggaggttgtag

SEQ ID NO: 136630 - DNA, 1003 bp, Homo sapiens
cagactgctgagaagcaaactatcaggcaaaattcagggcgcgcagcaggaggcagtcgctttcccggctctggggaaaacgatccaaccacgcccactctcctgcccgcccgcgcctcctttccgggaaaatgggctctgagaaccagagcgccctttctcccacgcgcccaaatcttttcccatcagcatgcgtgcgcttgcgcagtctccaggcggctcctttccagcgcccgaccgcttctttctcctgctctcctccggcttcccctcagctctagcttttccctaaggggtcatcacagggcgccaaacgcgcgtccgcgggaaggccgggggcggagcgcggcgcggcgcggcacgtcagtggccttccggccggaagtccgcagcctcccgagccgctgattggctttcaggctggcgcctgtctcggcccccgcgccagttttgggctggttggcgcggaatcgggagattcgggaccatggcacctgtgcacggcgacgactgtgagataggggcgagtggtgagggacaattccgcgcgcggggctccgggttgggacagtggcatgattgccggtggtgggggttctgagggaggcgcacacccgggtttgtttgggcgcagaccttggtcgtccccggcgggggcccttctggcgtcggaccgggcttcctttaggcgcggtttgctcttggaggaccagagcctggagggatttttgtttgggaggctgtctcacctctgccactgagagtctccacagtcgattgcgtttctatttcttttggtgagttgcacccacgtgctgggtataactttattgagactggccccgtggggccgaaagtatttcactgcgatctccctaagtatccacttgaaggcttgaacagaacagatctgtgtccctttttgtaggaacttccaggaaaattttatacattgtaactaagcaggaaagaaagctctaagtgctgtcatcggggaataacg

SEQ ID NO: 136631 - DNA, 1777 bp, Homo sapiens
tcggatcccctgtatatcactccgtttgtcaggggtgtcttttatttccaaaaatagaatacaaaaatgcaaatagatttgtctgattttttaagtgttcaactaaagcgtgacttcagttaacttctaacttaaaatcagatgcttcactttgttagctcaagcgtcacctctcctgtcattcagatacatcaccattaatgagaactcgcttcctaatcagcttcctttgcattcacctagttgtgagtcacagatttcaatttgttctagccgttcgttttttaagactattttggagagtcgacctgcctggattacagataggatgttgggtgtaagtatgtgaacgaacagtctttgcaggcctctatcagtgatttgccactaagccctttcttcatcctaaaaactacgtcatctatgaacatcaggaaatcactttggaggatactgtgcaatcttgagactcctcttaggtcatggtgttcattaagtagttgctggggacttgtgactggaatttttcctttagagcagactgaaggattgttacctgaaagactgctgtaagctagtgtctgtctgcttttggggaggatagagatactccagatggtaattttgaaacaaatatttaaacctttgtagctggatttttttcatgcttattctttttttgctaagttacctacgtgaagcattggagacatactccaaaaaacaaaatgtaggcttttttttttcttcagtattagcaggcagggcaccttgataatggcagtgaaaagttgaaaggtctgtaactagctgttactatatatgaaaaaagatcagggaatttttatttatttatttatttttgagacaaagcttccctcttgttgcccagactggagtgcagtgacgtgatctcagctggctgcaacctctgcctcctgggttcaagcagttctgcctcagcctcccgagttgctgggattacaggtgcccaccaccacaccggctaattttttgtattttcagtagagacagggtttcaccatgttggccaggctggtcttgaactcctgatgtcaggtgatccacctgtctcttcctcccaaagtgatgagattacaggcatgagccactgcgcccggccagggaaagtttaatgatcaaaaaagcaggtacagtggttcattcattggttcattcagcaaatatttattatatacctactaggtataagccttctgccaggctctggcattatgatggtgggtaggctggacatggtttgtcttcatgaagtacagatggtaaacatctaatcatatgcagaaaacggctttgctttgtttttgccttctaaagctagaccttggtactcttaggtatggtgtgtgtggggtatgtggatgtgtgtttgacttcacacgcggaagcgttacatgagccgctcctatattgctaagtgcaaagtaagataggcatcttcatgtaatccttaacagattttgaagcagacatgattatccccatttcacagatgtggaccctgaggctctgcatcagtcagagcccctatctgtaagctgcaggaaccaactctaccagattggttagaatttgttagaagaatattgtgttcacagaaactccaggaggactagtaagccagtctgggagctgtttagccaggaacagtgagtgaaattgtgccacaaaaatgggccagtgaggaggtcattgccaaccacgagcaagtacttgatgctatagctcatacctt

SEQ ID NO: 136632 - DNA, 3353 bp, Homo sapiens
ttcatccctttgtaatttggctcatgcctcttcttttgcttgtgccactttttactttgttctctgtgaaatttgactcctttttctaggcctgtattggaaacctctcctgtgaagccttccttgattttccaggcaaaattaacagctctctcctctgtacatttcctcagtactgagttcttaccttttctatggcaccatgtttatattgtgatggtaatttcaggtactttgctttacttgactgggggcctcttttggacaggcagctctgtcttatttgtgattgtaccctaaaccctgtgtagtggaacattgttgcctgtgtagtgggacgttgcctgtgtagtggaacattgttgcctgtgtagtggaacattgttgcctatggagtaagtgcatttgaagacctacagatgtcaggcatcaagggagtcttgaggggaatcgcttttcactttcaggggtcatgttcagtaatcttcaaagccttttcatgtaggcctgttcacgatttttgaaatcatttgagtgacatccaagtttttgtggctgtcatcattaagtacctttattccttaatttttacttaatgtctttctgaaaatggatttaaaagtcaaatgtgaaagtcaaacaatagagtgtgatattataaagagagattccatttctagaaagctagaaaaaaataagatctctaattatgccttacctttaggctatagtttccagcagtttattgccagcatttggtacatgttctttaaattgtatcttctatttcagtcaaacacttagtcaagcagcttaatgttgttatgaacattctagtggggttggagttttaggctgcctcttatccatacttcttttctttgcctgctcctttttataaattaattagcaccaaacacagtaaaatactagatttcacagacatagatggcaatcatgctgagcctaaactcgtagttgacaggcagcactgttatgcttgacttagtttttcatcagtgggtatgtgaaagtctttaattctgtggatgaatttttttttttttttttgagatagagtctcgctctgtcacccaggctggagtgcagtggtgcaatctcggctcactgcaacctccatctcctgggtttaagggattctcctgcctcagcctcctaagcagttgggattacaggtgcctgccatcacacccagctaatttttgtatttttagtagagttggggtttcaccatgttggtcaggctggtctcaaactcctgacctcaggtgatccacccacctcagcctcccaaagtgctgggattacaggcgtgagccactgcatccgcttgaatttttttcagtgtgtgtgtggaacggtcagtttatgatgatcggagcatgaataattcaaaagttgaatgaataaacgctgaagtcctctgatatttcagtaatttttgacaaaccatttaagtccctgtagttgttttagtaatgtcctgtgtcataaccaactgaggccttgaaataagtgatataccaataatcccctcagagccatctttgttaaatttctccagccctcaatctgttccttctttgaatttccgggtgctttggctgaatctcttttaaggcatttattatctctaaatattgtttagagccagttgctacttgtctcccatgttagatagtaagttctgtgagtacagagaccatgtcttttttatctttttttgttgttgttgttttttgtttttgttttttgttttttgagatggagtttctctctttttgcccaggctggagtgcaatggtgcgatctcagctcgctgcagcctccgcctcccgggttcaagtgtttctcctgcctcagcctcccaagtagctggggttacaggcatgcaccatcatgcctggctaattttgtatttttagtagagatggggtttcaccatgttggccaggctggtctcgaactcctgacctcgggtgatctgcctgcctcagcctcccaaagtgctgggattacaggtgtgagccaccacgcccagcctgtctttgtgtctcatagtgcctagtactttgcaaagagtagatgctccttgaagccttttagatattgattgacagattgcaaaatgaatagtgcttttataacccactggattacttctggctggtcatttctaatggaaaggtgataaattagctaacagctgatctcccttgtttagtgtctccgcaggatatcagttgaattgggaattttcctctttttagagaaaaaaataacagtgactttaattgttttaacaggatcttggaggaactttctggcgagtcatgtatatttggatatgtatgtttggccatgagctttgtgaattatttacattataaacattatctacttgtatattactaaaattgtatgttattgttggctagaaacttttcctttgtgtttgagggaagatggctgacaattttgtaacatctgttgtaaattttttttcttttttcagctctgtcagattcagggagttttgtatcttctcgagcccggcgagaaaaaaaatcaaagaaggggcgccaagaagccctagaaagactgaaaaaggctaaagctggtgagaagtataaatatgaagtaagtaaccatttttcttctttattcttcctgtgcatcatctaattcatagcctgcaggtagtcttatgtcacctttgccccagattagaaatactcatatattttaaactttttgtaatgggaatttattagtattggacaagcatgggtatgaggtagatttacagatcatggagaatgttcgacccttaaagttcctataaggtattttaaagatgattttaaaattccaaaatgaaagtacatagtcatatctatatttttccttattgagcatgctgtatctatggtaagtcccatgggtttgttggggtcatttagagatgcttttacttactcttaaggtattgagcagtctaagtgctacttcttggagagaactgttcttcctaatctcatttgcaagggtagtggcagtggagacttggaccttaacttctgccgtgttctgcttgtaagattgaatgtgatgctcttttggttttcctctacccactgtttatggcctgcaggtcaaaaacagagtggccaccatctgcataaatattgtctagcatcaccttcagggcttcctgagtatcttaattgccttatggccagaaagtgattaaccaatactagaaaataacaaccataactgatagactttttgaactaacatattattctaagtgtgtttaccaatgtgtt

SEQ ID NO: 136633 - DNA, 2220 bp, Homo sapiens
ggaaggggatggatgagggagattttccttctgaattgtatttggttgattgaacaggcatgaaaattatcgtctatttgcagagcgtacatcagctagtggagagggaagtggcatgccttacaggtttgctaagtgtaggagaaaccagtctagaaattacaagtgaataattccccaaagcagctaatgaagaattggctataattcagtttgttttttatgaaatagatgagtaattgatggtatgacaagtgtattatgctaatggaatcatttaatatcttatgttaacacccacctaaaaggaatactaagttaattgatgtctatttaaggaaaaccctgtagtggtgttgaatgtcagaactcatgatttggttgcagctactccttcagtctgccattccagtttcaatttgacaattttttcatcagaattatttaacactttgactcctctatttgaagcttttttcctgaaacttgtataatggtaggtcgaggacttcacaggtgtttatgaagaagttgatgaagaacagtattcgaagctggttcaggcacgccaggatgatgactggattgtggatgatggtaggtggggcggaggtgggggcggggatgttgcttcctaggcactgtgttagttgcttcttgtagattctcactcatgtggtggagttgctgctttgcctgggcaaatgtaaggcactgttaggatcttacctttggtttggattttcctttaattatttgaggatgaggaagcagaatagcaggacatttatttggggatattttggagaatctaggcacatacctcaggatgtagtataaatcctccaggtaatggctgtgtaagaattgggaggagccccttgtctgtggggccaatgcacagcgcttggaattaaggaatgcaggttcgggatccatcattcctactttccaattctatgaccttggacaagtcacttaatctctctgcgccttagagtcttcatctgtaatatggggatgagaaaactaccttctcccagagttgtgaggtgtatatgaggttctaggtatgaaaattaacttggtcagtagaaagcaccatacaaaggctggtcctaatgtcctgtgccccttctgaaagctcattggttctcacttgtagggtctgacttcatggccatgtgaatgctgaccacagggagcatgtagattgtgcctgtgactatttatgtttctacttgtgtagttggattcagctatattgccagttttcccttgtagactgggatatctctctgggcttgtggtaatcttgattcttttactttttattcttctggtagagtaaaactgctataaagcatcctattgtggcagactttgatcctttgggccaaatcgtttcctgaggtcacctgactaggtataatatatatcatttggttttgactccacacctgctgtgtggatgctgtgcattgtctgacacctgtgtgaacagaattctgctgcacttaaaaatagcacaggccaggaaaacatctgagcaggtataaaaggtttttttggtcatggctaaaatattattggccacttttagaaatttgatcccagtattaaattttgtccctgcagatggtattggctatgtggaagatggccgagagatttttgatgatgaccttgaagatgatgcccttgatgctgatgagaaaggtacctaccttttgttttccagggtgttgttttgagatttaaagaattctctaaaattagagatgacttgatactctgatagtttacctttgagagaaggacctaactaccattgtttttagatacggaatatgttctaagatgaagagaagtatggttttgtggaaaattaaacataaaaagcagaaacaacatcaggaaatgaagtttcatgtctctgttattcaagtagtgtggtctttacttattttgaagttttcaatcccgtggtcatttaaaacttgctgattttgagggctgcaacagtaattgatcttttttaattcctactgaagttatatacttagaattttagctctttgctaattgtatagcacaataacaaggtttagaactagagtaatcagcttgctttgtctaattgaaatttaaaataatatggtgaatgtgtcagattgtcttagctgtacaatcattggcaatttttttttgagtaaacaa

SEQ ID NO: 136634 - DNA, 1047 bp, Homo sapiens
ggtgggcagatcacctgaagccaggagttcaagaccagcctggccaatatggtgaaaccccatctctactaaaaatagaaaaattagtcgggcgtggtggtgggcatctgtaaacccagctacttgggaggctgagaatctcttgatctcttaaacccgggaggcagaggttgcagtgagccaagatcgtgccactgcactccagcctgggtgacaggaataaacaaaacaaaaccatagagaaaaatatcaaccaagtcccagtgaagaaaaattagcaggaaaatgcaataaaacaaaacagaaacactaaactgtggaagaattccacctcaaatatttacttgtattcaaatttttatccttctgtctaaatcctgccaacctacagtggtgagattaaagccctctcatgaagccttccttgctattcaaacctctgttgacctcctctgttcatacactatcaagacctgaattttatatactaaacattttgactattaattacattctgttttcagagtgctccagatgatacagatctcctgtctcacatttttcacaaatgtcctacaatccttttcacaatcttaggctcatgaaaatactttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtcttctactttctacacagacacggcaacca

SEQ ID NO: 136635 - DNA, 1615 bp, Homo sapiens
aaaaacatttggcccatgttttcttgaattaaactcatttaaaatattttttcctacataccttgtatagaatctcatagttttgttttgttttgttttttgagatggagtcttgctctgtcgcccaggctggagtgcagtggcgtgatcttggctcactgcaagctccaccttctgggttcacaccattctcctgcctcagcctctggagtagctgggactgcaggcgcccaccaccatgcccggctaattttttgtattttagtagggacagggtttcactgtgttagccaggatggtctcgatctcctgatctcgtgatcctcccgccttggcctcccaaagtgctgggaatacaggcatgatgtatttttaattcttaacatttttcttcccaatagagatcaagtgactaggcttttagttttccattttgatttttgctgatgcatgtttctaaataattcatattccaataggaaaagatggtaaagcacgcaataaagacaagaggaatgtaaagaagctcgcagtgacaaaaccgaacaacattaagtcaatgttcattgcttgtgctggaaagaaaactgcagatgtgagtttcatggtttccttattttttgtattttcctttgtgaggtgaatttaatatttgattatacagataacaggtgctctgtatatatttgagtaacatttttccaatttcactcactaagttggatgtagatttctaagtgaattaaggcacctcagtggttggaacttgcgaaatggaaaagagaattgaacagaaaagctgaattgagagtgtgtttaattttagtgagtagcaggaagatcatggattaagggcgaaagtagaggatgggagctatagatgtaggaatgctatatacacaggtggttgttaaaatctgtgaatgtagatgagcactcagagagtgaggaatgaagaggcaaggactaactggctaggtccttcctttcatatacatgtgtgtagttttggtgagacattttaagtgcaaggctttctcatgttacctttctttatcatttccagaaagctgtagacttgtccaaggatggtctgctaggtgacattctacaggatcttaacactgaggtaaatgaatctccaggagttgtaaaatatgcagaggacatagactgaagaaacactctagtaattatacaaaacagactattgccagaattttttctttttttttgaaacagtagcttgcactgttgcccaggctggtgtgcagtggtgcgatcttggctcgttgcaacctctgattcccaggttcctcttccctgattcctgcctcagcctcccgagtagctaggattacaggcacctgccaccacgcccggctaatattttgtatttttactagagactaggtttcactatgttggccaggctggtctcgaactccttacctcgtgatccgcctgtcttggcctcccaaagtgctgggattacaggcgtgagccactgtgcccggcctgttgacagaattttttaaaatgtaagaacgccaacaaaaaaccccccaccaaaaaacaaagaaacccccttcagattggttttatcccaccattt

SEQ ID NO: 136636 - DNA, 1395 bp, Homo sapiens
tgtgtttattataggtattacaactgtggtaaatgcaataattttcctcccagaagcaagtatttttttgtaaacctaggtaacagtaaaataattgaagctgttacattaataatacataaaatctttttataaaagggaactgtcattatctttggtcagggtaggacagttgcatatttttagtatgtaggtctaactgactaaatatttaaaaacgtttacaggcagttccttcaggaaaaattgcttcccctgtctccagaaaggagcctccattaactcctgttcctcttaaacgtgctgaatttgctggtaagtgtgatgtcaggcagaattgcaagagtgttgagtggtttctgtcaaaaatggaggccctatgatggaggaggtagaggagattttgaaggtgttgtgatggcaagtttaaatgtgaagatttgaattcataaaaatttcagtaaaagttaaaaacacccaatttggagattaaagagaaatgcaaacatagtatagaaaagggacaggctgctattttagtgttggataagcctttgtgcgcctttgtgtgcctttgtgtgcctttgtgtcatcgcaataacacatgacaagaatgtgtgatgatgcctacaggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttgtaagagcattttatgacttttctggcaaataggaccacaatttttctgttggattttgaaaggtttttgaaaatgtgatttctgcagaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtaatcatatataaggtaactatatgcctttaactcagagtaggacttttcccttaaatattttattttttgtttctttttgtgtgttttgtctttttatttaatcagtttatttctgttttttttttctttatccttaaatacttgagtcactgtaattagctcaggtcaggccctgccctcacttaacatgtattgtaagagagcgacactcattcattgtaaagtgaatgcgccaccctgatggagaagagctatggtgcgaataatccttaaagatgcttattccaaaa

SEQ ID NO: 136637 - DNA, 1062 bp, Homo sapiens
gactttgaaagcctcgttaaggagtttgaatcttctaagagcaatggggtggcattggagggttttaagtacagggggtggtggtcacgtaattgggtttacattttaacaggaacagtggtttgtgtagagaataagcactgtggtgcatgtgtgcgtgtgcacacacacgtggagggatgggctggtgtagggtaatggggaagtgtggaagccctggagatcagtcaatccagggcagggctgctagttacttggaccctggtggctggagaggagagaagtaaaggcatttgacatgtcttttgacacaaacttgttaatggattggatgggggaggtgacagaaaggaggaatcaaggatgatttctaggtcatcttaatgagctaatactgtgaattcttgactcacaaaaagcccggaggctgttcggtattcttttgtgcctctttgagcccgtcttcattgtgggactgtgcattgcaagatctgtcagattaatgttaaatacagtatgcactcttaaacagagttgtctttatttagatcctttttggatctgtggtacatgcaaatagtgtatttttcaaagcggtttcctggaggctgtatctagtgaaaagagagggagtacctagatgtcagcaaagcaagcgtgtgagtaaattgaaggccacatttaccttaaagataaccaggcattgactttaattggaaaaatgttaatgatctctggcaggggtgggggcggtcagaagcattaatatgcttcagcttatcaaatatatataaactcttgagccacttgagtagcacactgccatgtgttagtttcttaggaaaagatataatcaattttagaaatgatatcttaatttactttagctaggacaaaatgatttgattataccccctcacctctttgactattttgttactctgctggaagtctggcaagtatgattacatgaggctaagcagatgatttcccatccattgctgaaacccagggctgccccattgtacaacctcagggaataccattttcacgtgactttcc

SEQ ID NO: 136638 - DNA, 4143 bp, Homo sapiens
gcttctcaccctcagtccactctgctgttctggttccgtggtacttctcaagttgtgttctctcctatggcacatcttctctgttattgatgccaacgggttaaataagatagcttaaaaaaactcctttaatctcagagtgttgaacactttcattgtgatagcaggtaatgatcactgagctttggtgaaatcaatgctgctaataaaaatgaagtactccaaaagaccctgttattgtttctcactttctaacagattctaagtaagtcagttgttgctgaatgctccataattatgaaaagaatcttactctttgcatatgggaagatatcctgtcttcattatgactttttcaaggttgaataatcctgactgcacctggtttcagctagtaactttggggggaatgtgatctttgtttaccatgatctttgttgtgtcaaatgaggcataaacagtgtcaaatgtgttgcatgaagtgtgatattagtttgacagtaaaatgagcttatttgaatctttgaatccaatattagggtctttatttttctttgcatagcattttgtttttccatctttaactgttgtgaggatgacttttaattttctgagttactgtgattttttttctttcttaatcttcccatagtccttccttccctctccctccccatccaccctccgttaccccctcaagctgaaagtctcacaactcttgtaagaattttaatcatctgcagaaatgaaaattcttagatcgtcttatttctaccaggatgtgtgaaaaaaggagtcactgatgagtagtctttcaaactggggtaattgaccttgtgaacagtagcctttgcatgtaccagaattttcttagtgtctcagataagtggctgtgttgagtggctttgttgattactgctgtctaattattcatggagcccaggattttgcacagtgaccatctcctgggttgactaacaaatgtttgcagtctgttcttcgtggccaattttcataaacaatgatttgatgtctaaaaaggtgtggttttactttatggtattcattacttaaattactgaaatagaatagaaaggaacattataaacacttacctagttagatgtcctaagtagctgtgaggtagaaaaggtgaaatagaagataatagtagtccctattgtgaggtatttattattatatggaataagaaataagaagtaaattatgttttttgtaaacacagttttacatatagaaaaacactgatgcactagttatcctgatacatgaatattggtttttataggtaaatacaagcgctaaaaaattagaattatattctcagatctgtaatctcacaagaggcttaattatgagatttgttggaaaatactttccttatgtttgtttctcttttttttttcttgagacagggttttgctgtgttgaccaggctggtctcaaactcctgagctcaagcgatctgcccacctcggccttccgaagtgctgggatcacaggcatgagccactgtgctcggcctgttttgtttctcttaatctgtataatcctggttgtggggaaagtgtttatgcaagttagagaatcattctgtcccctgtcctcccagtggtcatacactgtatcattgtgttagtgtagtatggcatcagtactgagtaaagaactggtcttggggagtgggaaatggatatatttgctgtcaaaatgagttatcatgaaggtataaatgtgtggacacattcagtgagcctctatattgttcctttaattaggtgaaattgaaatgtttcttttctcgtgattttcacttattctttcaggtgtggtatttctgtttgggaaagtttggattgaatcagccgagacccatgtgagctgttgtgtcatggtgaaaaatatcgagcgaacgctttacttccttccccgtgaaatggtaaacattagtgattagcttttagttctcagtcgttgtatctgccacacattctgtgttttgcagccagctctctctctttcaatagggctacaaattctctacaatcctgatgcttctttcttgctgcttgcctggtgaccactgattgtcagcaattctattagaggttgggaaaagtagaaaaaataaagtagaactcagtttttcaactagttagagtataaaagtttctgagatttagtatataatgctttctttctctcactcctcatttccataataatcagggttggaactataagtctctaaaatgtgacatggcatttggcccagttttcatggttttgctgcataggcagcagtgatattccctccattgccatttattaacaagttcaattctatttgcttctttttttttctttattgagacggagcctagccctgttgcccaggctggagtgcaatggcacaatctcggctcactgcaacctccgccttctgggttcaaacagttttcctgcctcagcctcccgagtagctgggattacaggcgcctgccaccacactgagctaatttttgtatttttagtagatacagggtttcaccatgttgatcaggctggtctcaaactcctgaccttgtgatctgcccgccttggcctcccaaagtgctgggattacaggcatgagccactgcgctcagtctgcttctccttttttattgggacttaacatccccatttccctctcagcccctccctatatcagttgaactgtggagtctcttggtcaggatttacaacacttattcttccattttgtagacttgatcatctttatcgctgatttgttttttatgatgccattgggaggaattgggcatttggtttagtacattttttgggtctgtttgtatctttgaacttatctgtaagactgctattaaatgtttaaatgggtgaggatgaaaattgatatagacttggatttttggtggttgagaagatcatttatgtacagatacttttttttcccctctgtccccttctctgggataacagaaaattgatctaaatacggggaaagaaacaggaactccaatttcaatgaaggatgtttatgaggaatttgatgagaaaatagcaacaaaatataaaattatgaagttcaagtctaaggtttgtatttggcgatgatttttttccagctctgtttgttgtttattttctgatttagcaaatagttattgcatattttctttgtgtaaaatgccttctgtgcagctataatttattgaatggaaatttcataggtatgaatgtaaaaacagtatattagatttgcaaaaatattttttctttctctttaaactgcttataaaataatgtttattaatttgaatagaaagacaatccatagcaaattaattgcctctggtgcttgcaacatgtcttgtgctctcattcccaagtgcagaagaaactgctctgatctcgtttatattagttgttgccaagatgttttggttagaaagttaagtaaggttttatttttaaaagtcagggactatgatacagtctgatagaatgaaaatctctggttcatgtgctagttatgatacattgtcttgattttagtgagatattgatgtctttggccataatcgtgggggctatagcctgctcaaaatactggctattaataatgatcgcaggaaggattgagttgctgaagataaggctaacagtattaactatttgagttttgaattgccgctgatgagtcaagtctttataattctagaagcaattgtgatatactggtgaagagcttaggtgctgaggccggactgcttgtggtttaagtcctagccctattacttactagcatgtaacttggacaagtgctgaatgactactttttttttttttttttttttgagatggagtcttgctctgttgtccaggttggagtgcagtggtgcgatcttggctcactgcaacctccacctcctgggtttaagcaattctcctgcctcagcctcctgagtagctgggattacaggcacccgccacaatgcccagctaattttttttgtatttttagtagagctggagtttcaccatgttggccaggctggtcttgaactccagacctcaagtgatccgcccgcctcg

SEQ ID NO: 136639 - DNA, 1448 bp, Homo sapiens
ctgactttcagttacgagtattggcagggcttctcaagcccacagttcattgaggtggatttatagtaatgaataattgaaatggataaaattaatttaagtatatagactacaggttacactgcctttctctgcttttgagtatgcatctttaaataaataagttgaaacagcacgactgtttgtcaagtggaatgaatgccacatgatggagttggacatcattagtctgctgaagtgtcccttatgagcagtggaaaggtgagagaggagtgtcagtagcattgctatagtgctgctcttgctcctgtgacaggcaaggtcattgctataggatgttaattaactggaccttaacctctttttacctctgttctagtgttttgttcccacaacgttggaaaaggaaaacttttaagaactatttctgacagtggtgatgaaaagtattttcaatgagttccactctgttgctttcattcttctaatggagtggtacttacttggctattctttatcagtaaagcatgtacagctctggacagaaattttcttttgggggagcttcttggcctatttttcttctaatgggtgtcatcaagatgcattattttgtcattgtgaattggttttgtttcctactgtgaattgttttggatttcatttgtggcaaattacatttcatatatatcaaaggggttttcttctgtgcttcatagagaggcttttgtttatttcaaatatagactttggaaaatgcaaagtaatagttttaaacaaaaagattctttttttttttcctttttcaggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacgtaaggaaaaatacatgctcagaatgctgaatagattgctgatagatgtggtttttaaaagggaagttaggaaattgatctatttattttaatgtgtctacttccttttctgtttgtttcttcagttttcgttgagtgagtatagggagtacatttggaatcaccttatctcggtaatgcctggcggtttagtctgagggaggccttagtttggggtgcatccctcattatgctgttattcatatgtacttctgacctggctgatgtggcccagctgttgtgcatagtgaactgctgacctttgaaggagaggagaatcactattcaatatggatagtgcatgtttttcctgttacctgatgtttttcagtaattgcttctatgatagtctgctttgtcttaaaaatgtttcatgattcctccaaggcagtgtttcagtttttttaaaacctattttgggtcctggatgctttggagaatctgatgaaagctatagacct

SEQ ID NO: 136640 - DNA, 1074 bp, Homo sapiens
catcttattataccagaaagcaacgacagtattaaaatctactgaagatatgtcaaaaggactcaggaatcaacttgaagagtcttctactgaacaaagatgggacaatgtgagggtaagaataagttgaacagattgcaacacatcagatccatgagttcataatgatattgtctgcaatgacaccacatcgatcacttctgaaggaagctggggaaccaactcattattttgaaaactgataaagggattgaatgaaggtttttgacttttctgaacacatgctatacctcaggcaaccaaataattgatgaggggaagtttctcttcatagacggtttccagctaataaatgaaagataaatggaatagtaccactttgtaattgccggtgaaataatggatctaggaagtgatcaccagtgggtacttatatctctaaggtagagatgagcagacattatgtgcctgtgcctttggatagaagtaatcagcgcctctaaagtattcttgccccagaattgaacctgattttgatcaagcttttagacctaactatgaatttatagacagtatggagacagaaaaacaagttaagtgacactgttgggacacaagtagtagaatccatactatggggcactctctaggacaaacagcctagtttctttagcaagtaaattataggggaatgacagatgggatagggttgtacctgtagttttacatatcagccattacaaagtatggtccttgtgtggtaaataaaattgagataattggaaaatatgaaaatttaaattctgcctggataattaatgattttaagaaattactattcatgtaattgtattaggtgagataattgtattgtgattatatttttcaaacttcttatctttcagagtggtggtggttgtcagctgggtgagattttgcctctaaggggacatttaacaatgtctggagacatttttggttgtcacaactcagggggtctgggaatggtaatactggcaactagtagggagatgctggggatgctgctaacatcatacagagcacaggacagcc

SEQ ID NO: 136641 - DNA, 1049 bp, Homo sapiens
tatgtagaagagagcaatcatgagttcatttcaacacgcatttattcacttcctctatgtacgtcactatgtgaacagctgttgtgtatggtaaggaacttacagtgtgtaataggggaagctttggtcaattttaccttttcagaaggctgaactgagtttctccgctgtatgttgcttgcggcattggtggtggtgggatttcctttgaggaagactgctaaaatcttccattctggcttcagtggatagatagcaaatgtttcatcaaagcagttttaacaactgcagggacttagggttctgtgcttgaccattcttttgaggtcatcaacatgaccagtggaagtatttgatgaccctcctaattctttagggttggggggaatatatttaagacagtttcgtttggaaacatgtactatatgattacctgaaattagactaagatgggtgttggaatctttattttttttcctttttacagttgtgtctaaaccaaaggactgtatttttccatatgctttcaaagaagtcattgagaaaaaggtaaagtgctcattatatgaagcatctgtttgtttggagcgagaaagaaaaggggggtggtatggactagtagaaaaaaggtgttttatattttattagattcattcctgccagattggactatgacatcgacccattaaaatgtattagacatacacctagaagcattatttaacaatgtttaaatgttttactacctgaaaataatgggattctgtactgtattggtggttggataggctcaaacccccctccaatagcttaattagaagcttctctaaaatgcatgatcatatgattcctgttttgggaaggtgttgggtagagtccctccccagcttgagggaagctaaatgaagttgggaatactgtggacgttaaagagccatgtattgacaaagttgacatggggttggccaaaatggatcagtgatctctaaattccagcgtgctccatgaagaagttttcatgggtccttaataaaatggggaggagtggg

SEQ ID NO: 136642 - DNA, 3169 bp, Homo sapiens
agccactgcgcccagccacttataattcttaaatatgtttgtttttagtctagtttcttatttatcagttctcatcttaccatttgggattattttatacaatccttgggatttctttgcccagtaaatacataaacagtgaagtctaccagggattatataggaaagtaatgtttttgataggtactctgattcatatgctctaaatgtgtccagatgcacaagcatgtccctgtggagggacatttctatattttatgttgctcagcacttaaaatattttgctttattcacatgcttattactagaatgagctcctcagagactttgaaattattactatgaaacctacaatcaggaatttcattgctacatttagttttgaaatggatggtttcttttaaccctaagaaatcttaccatagttgaacaagaagccaagatacagtacttgcggacagtaaagagtcgtcagtgactggtgtgtttttatctaacagaatgtgaaggttgaggttgctgcaacagaaagaacactgctaggttttttccttgcaaaagttcacaaaattgatcctgatatcattgtggtgagtagatgtttgatcatgttgtggggaagctcttcatttcttagttcttttcagtgtgactttattggtgcttttgagcagcaaataatcttttcagagtaaaatgatcctgtggactggtgggaattgctgctaataggagaaaaaaatagcaagcccactgcaagatagtttttttttttctctagtataaaagcaacctatgacttagtgttgaagttaaggattgtctggctatttatgcttagagaccagcacataaataagtaaacatgtacaaatggagttatcgccaaaatattgacttagtagttgtatagtggtcacaggagtttattaattcccttggtttggtgcaaatcacaaaactaagtattttaattttatgagttcagtggatctctatgacatattcctttgaaaactcagggctcggaattgatttttctcttgacgatccagtatatccccactagatagcttgagctaataattcattgagctattttttgccccaattcctgagagtcataaggcaacattttgttttatatatcctctggcctttctagtttgtagaatatggaattccttcatttgtcttttttctaggttaatggatcaatcatattgtttttgttttttcagaggaatgtaggctataaatgcctatattttggatgtgatatgggtaatttgggtacattaaagtcttgcaaaagtgtttgccgtattcttccctacattcatttttactcttggataccttatctggcaactgtatagctagcatcctgagttcctgtggataggaagcgatatctctgcacccacttcccttatgatatttcaagacctatctttaaagttccaaaaagattctgtccacagtgttggactgtgacattctgtctcagcaccaggccctcagtcagcctccaataacaacagtttcttggaccccaaggagatgccatgaagcctgggaaacctggcctggcttcaggtgttagagccaagtctatgcgtgagaaatctagatgtaagatggaattctgacatgaatatgggtccctgattctaggtattataatttgtaagtgagacttcctcaaggcctttgggtcttctaatttaataagcaaaactgctataaatatctagtggtaaaatacatataaaattaactatgttgaccattttatagtatacagttcagtggtattaactacactcataatgttatacaaccatcaccacgatccatctctgtaactcttttcattttgtaaaactgaaacgctgtactcattaacttcccattccccggcccctggcaaccaccattctgctttttgtttctatgattttgactactctaagtagtggtatatatttttaattaagtttaataacaagtatatttattgatgtgaattattttaaacttcatctaatttttgataaacataggaaagtgaatcatgttcacgtgttggaaattacggaaatgaaaaatctagttgcatttttgagataatttctactctatatagttttgtttctttgtttttaacaagtttcttatttgaactatttagtggtattatatatttatcttgttgcatatcaattatgagtctaaatcagtagtgtttgaactcaatttttaaaaagaagctaaatgcagttcctgagttttcgaagaagtcttacataaactgtcatacaacaccaggcaggttctgtgtttttaaggaagcaaaatggaattatttgaatttagcttttaccgatcatatgaaaagtatgggacattaaatttgcattttcctccgagaccgtaaggcatgagctgcaaattaaaagatatcatatgagccttgcatcaattaggatgaaataaagtttattccagcaatctgcttagcagccttgttaatgtcaaggctaatgagtgctgctgatgaataaattcctgaagaagaaaggacccccaatcggaggtaagtgcatgatgtcttcaattagagactagaaaaagaaagggcaaagaaattctgtgcgtatgaagataaatcctctaatttgcatttgttataacattatcagctgccttctttttctgactagggtcataatatttatgggtttgaactggaagtactactgcagagaattaatgtgtgcaaagctcctcactggtccaagataggtcgactgaagcgatccaacatgccaaagcttggggtaataataattttcaaaatcttatttatctatttattttaatttgggatagctaccaaggaacacactatactttttaaaacaggaattggttatcttgttatgggaacttcagtacattttaactttggcactaaacatcttttcctttgaattcagcattttatttgtaaaagcctctggtagttttggccgggcgcggtggctcaagcctgtaatcccagcactttgggaggccgaggcgggtggatcatgaggtcaggagatcgggaccatcctggctaacaaggtgaaaccccgtctctactaaaaatacaaaaaattag

SEQ ID NO: 136643 - DNA, 5314 bp, Homo sapiens
tcaaagttggggccactgctcttgcttcttttcttattcatatctttaaggtggtagagttgttattagcacttcatctgaacacttgcttagctttttacccccttcaagattttctttatgtggcatcttctcagtgaggtataccccattaccctatttaagatggcagtccccccgtattccttgtacccctcaccctgctgttttcccattttccatccacttgttacctcctaaaactatataatttcttgtttatgatgtctgttttttattatacatttcaaatgaggccaggaatcctttctgttttgatcactgctgtatcctgagtgcctagaataatgtcagatacatagtaaatgttcaaaaatatttgattgatgtatggaagaatgagagttttatcataattttgggccagcttcaaaataggttagaaagaaatgttctcagtgtctgctctttcatgaagtttgctttttgttcccatcttgtagggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacaggtatgatcctagattcttcagaattcatctgtcttgaaattaacaacagcaggacactactagtactatccttagtctggagggacatgagccagtggtgttgtagaggggaaattgtctctactactttcataatttgaactagtttacctcttgaattattgtaattgatcagtttatctccgtctccctcacctgtgttaacactatcttgatgtttcctaacagtagtttggatttagatttctactcttaattcatttattcaggaattagggtagatattttagaaatataaaaactgagcaatcattaagttagaggtattgcttgcttatttcttcctcctactcctctggccatctctcattcattcctgctagttcttcctgagttctttcttggacttctcttttctgactttgttctttctctaggtgatctcattgagtcttaggaatttaaataccatgggatggctatgcttcccacctgtgtatcttcaggttagacctccctaaattccacactcagtgtatctgttttacctattttacttgatatctaatgtgaactcccagcttgttcaaaattgagctctgatcttctatcctaggttcttcctatagtctttccttactaaattaataggtgtattttttccattatcactggaaacttccagagtcttacttagccccacatgtctgaggcatctttaattcctctctctgatatcccacagtagatgcatcagggtatcctatcagttctatcttctaaatagatctaagtctgaccacttcttttcaactgcattggacccatcctatccaagctgctatcctctttcccctggattactgggtttatatgcctatccccttacttttgcccttacccccttgtggtcgattctcaatccagaatcagagttatcctgctaaaatcaagtcagatgtgatactctgctcagaaccttccagtgactctctgtttcattcagagtaaaaactaaagtccttatttttacttacaaggtcctttacaatgtgtctctatgtcgttaactctgtccttatctcgtactgctctttccatcattctctctgatctagccatattggcctctttcctagtcctggaactgtcagatttgcacgcagctcaggacttttgaatgtgctatcctgtctgcctggaatgctctttccataaggcttgctccctcacctcttcaagatcttcattctcagtaaaatcttccactgtttcctaacaaaaatttcagtctctgcttctgatacttaatattcccgttgcttaacttttaacattatataacatactatatacttaatttctttgtttttttttatactctgtctcccccgtgaggacataagctccaggaggataggaagttttgtttgttttggtcacagccaatgcctggcatatagtaagcatgcaatacatactcactggatggaatgaatgaaaggatttaggtagttttcaggcttgtagttattatattacttcagtttttccttatgggattttgtgtgtgtgtgtgtgtgtgtgtgtgtgtgtgcgcgcgtgtgtgtgtgtgtgtgttttggagaaaagcattgggatcagtggtatgaatgaattcctagttacatactgaccttattttaaattgtttctgaagccaaggtgctgttgctctgaatttacttacacccagaattccttataatattttgtgaagttctgattataggcattgtttcttttaattacttgattctgtttcattcttacttttctgtacagtgaatcttctcaactgttatacctgttggaacacacctggaaagatgccaagttcattttgcagatcatgtgtgagctaaatgttcttccattagcattgcagatcactaacatcgctgggaacattatggtaaatttaacttagaaagggggaaaaagcatttcctgttggattcagtgtttgcttggggtagttgttatatgataatgagtctaaatgcatgcttataaaatgagtaacttggattctgaaagctggatttcttttgtaaaaggaagaactggttgggagaaggggaggaatgccaggtgcagcgtgttgaaatttgggtgaacatacggatcatctctctaacatctggatgtgtctttttagtggaatggtccatttgggagtaaataaatagccaagttgtcaatattttaagctctctttgtctcctttagctataatgcttaaagaaaacgttaggaataatttagtaccttttttttttttaaaaaaaaagcagaccgttattaggaatagttttgaaggaggtgctgtgactaaacttactgactcaaagttgcttttgttagttgtggttttgagctcaaatttaaaaaataaattccatttaatagtccaggacgctgatgggtggacgatccgagcgtaacgagttcttgttgcttcatgcattttacgaaaacaactatattgtgcctgacaagcagattttcagaaagcctcagcaaaaactggtgggtccaaaactgtgtagtattttgttttctcttaaccccccccccccttttaatacctagatagccttttttttctgtgataacatctgctttcaaaatagctaatcccttgtgtactaaagaaaccgtgtcaagtttattcccttgtttttgtgtggtcatttccttttccactttgtaaaaggaaaatgcactttgtgcagacaaaattatttgtgaaatgtgaaattctttgagggaagcattagacctctctgatgggtgaccatacatggaatgtgttctggcacctcagccctatccaaagataaatgccagttaaactttttattttcttaaacctatgagcctttatttttgtgttgcatttttctgtactagtatgaccaaggtcacccacagtcaggtttctgaagtagcctccatcactttggaactaaaacttagtttagctactgttttattagcactgatattaattaattcagaaatgggaattgaatgttagaatttgattcaggttctcatatttgcttgttttttaatgtacattatcaaaattggtatagggcatattcatttagaggactttaacttctgctgaggtattgaatgttggccagtaataaactacttaggaatggattttcagtatatggatgtacttgttttatggtgtccatattaataatagggataatgataatacctgcatgaagtattttatgtttttacatcacgaatgttagagtagtgattttaagagggctgttttataatctcaaattttatataacatgaaaagtggtatttttcaatattcattgatttaaaaatatgaaattctgtaaattcaaaaacacataaaaatagaattttcatatttgttaactcaggatatagtatttgtttaagaaattactatgcttgggattcatttggattcgtgaacatattacaataactgtctttcccaacagataggaccactaactgaaatgtttgttagaactaagtcctgcaattggaaaagagagaatcatcaaaattttaaattagttaattagttgctggctggtgaagttatctttccatttgatattagggagatgaagatgaagaaattgatggagataccaataaatacaagaaaggacgtaagaaagcagcttatgctggaggcttggttttggaccccaaagttggtaaggctgggcagtgaattggttttctcccagtattaaggaatttcttaatgtggatctaggcttgagaaactagaagactgaattatatcttatagatcagcgaataggtctcatgacttttatctttcgttcacgtgaaaatcttggttgccagtcacctgacatagacttaatgtgaattttgttatgctgtgttccaataaaatattatttatagacattgaaatttaaatttcatatagttttcatatgtcatgaaatattgtttttgatttttttccagccatttaaaaatgtaaaaaccatacttaagctcatgggtggtacaaaaataagtaggttggatttggtctgtagccgtagtttgtctaatacatagatagctgtccagtacatagatagctgtttgtcctgaccagttcagttgacagcaaagttgaaggacgtgcagacaataaccaccaaatttaactttaataggagaatatctttttccctattgtcatgaatggcaaagatgttttgtggtacacagagctagaaataatttttttttctttttttcttttttttttttggagacagagttttactctgttgcccgggctggagtgcagtggtgcgatctctactcactgcaaccttcacctcttgggttcaagcgattctcctgccttagcctcctgagtagctaggactacaggtgtgtgccagcatacccagctaatttttttgtatatataaaaaaacatttcaacccttcccaagtgtacagttcagcagtagtgttaagaatattcacattgctgtgaaggaattaatgtgaattttatctaataagttagttctgagt

SEQ ID NO: 136644 - DNA, 1937 bp, Homo sapiens
gttccactactgacatttatatatatgtgtctcttgtttgattttagctcagtttttgtacaggtaaatgtgccgtccattttattttttgaagctgttgtaaaagaataaattactctaccaggcgcggtggctcacgcctgtaatttcagcactttgggaggctgaggcaggcagatcacgaggtcaggagatcgagaccgtcctggccaacatggtgaagccccatctctactaaaatataaaaaattagccgagcacggtgttgcgcgcctgtagtcccagctattcgggaggctgaggcaaggggactcacttgaacccgggaggcagaggttgcggtgagctgagattgcgccatggcactccatcctggagacagagtgagactctgactcaaaaaaaaaaataaaaataaaaataaaccactcacttggttttatttggggtggggggtgggagagtaggtaggaggattcttcaaagaattcttgctttgaaggagagttgaacatttttttttttttaatggatgtgacacgtctcagatagctgattgggaaggtatttgctcataataatggtgtgctttggggacagctggggaaaggactggttgtagctggttctaaagagagacaggatctttttctccctcttcttttgtgatctggcttttcactaatccgcatcattttatgaaatggtagttgattctttttttccctttttgtctgtttcacagctctgggtagtgtatatggatagtatatagtttctaatatacttacagtgcttttaataatgatgttttgacaattctgcttttctttagactttttatgacgtggctttttaatttcaggtttttatgataagttcattttgcttctggacttcaacagtctatatccttccatcattcaggaatttaacatttgttttacaacagtacaaagagttgcttcagaggcacagaaagttacagaggtttgtatttaacctgggactcttgaaattgagtttaaaaaaattgcttaaagaaggaagatctgtgtctttttaaaatagttttattgtggtattattcatataccatatacttcacctgtttgaagtgtgtagttcagtggcttttagtgtattcccagagtttgcaaccatcatcacaatgagttttaggatattttcattattccccaaagaaaccttttagctgtcacctccctcaatccccatcccttccacctctaggcaactactaatctttttgcttttatagatttgtgtattctggacgtctcatataaatagaatcatacattatatggcctttcggtatctggcttatttcacttataatgttttcaaggttcatccattttgtagaatgtactagtactttattcgtttgtgttgctgaataatattccattttatatgcgtgtgtggtgtatgtgtaggtgtatacacatacaccacattttgttcttttttgtaattttttttaatacatggcagaagatgtctgtttgccctctagctcctgaatttatatgtcagttctcaccgcaagcttaggacctgtttttcaatcccaatttcatattcccagaagagagaatctgataggtttgcctaggttggtgagcactccaggtccccgttacctgtgaccacaagagtaggttcacagggcacggatctggctgctaagggtggacctttctgtgggactagtggatacttttacagagaagatactgggtagacatccccaaaaggtatgactgcattcaattaatatttgagctctgttctgctactgtgccagcatggtgataattaatattatttagcctctgcccaccaccattttgcttattggagctttccagcttggattctggatatataatagaatcattttagagttg

SEQ ID NO: 136645 - DNA, 8064 bp, Homo sapiens
gagtggattgtaaacttcctgactccacatctttcagtttactttttatctgactttcatagttgctgtaaataaattagaatgtgtaccaggatctctttaatagatttactatcatcatctgttatattggaaaacagtaggtccctattactattgtaacagtgttcacttgaagatattgatctctataaaatcagatgctttgtaaaggctaggttatcaaatggcattgacttgatgtactttaaaccaagaggtttatttttaattctgaacctttgaaagggcaaatgtgcctggcttttttctttgtagctgttaatagaatttacggaggctagggaaaaatggtctaatgcttcccctgctttttcttcctgtaaattttaatataagaagactgctggttgcttttctgaaatgttgctattcttctgccgattgcatagcaatttataggtaaaaggtactacataaatgttaagggatatgtatgtattagtttttagaaatgtcatggcctatttaaatgtgctccaagctccttttttttttttcttttttttttggagatggaatttcgctctttttgcccaggctggagtgcaatgttgtgatcttggctcactgcaacttctgcctcctgggttcaagcaattctcctgcctcagcctcccgagtagctgggattacaggcatgcgccaccatgcctagctaattttgtatttttagtagagatggggtttctccatgttggtcaggctggtcttgaactcccgacctcaggtgatccacccgcctcggcctcccaaagtgctgagattataggtgtgagccaccgctcctggctgctccgaactcttaaatttgctgatttattagcttttaattattagtctacagcatttacaataactgctatgattctccatagttttaaaattctatagcattttgtttggtagtaaaatgatttaaaatagtagtttagctgctagttattttgtttttttaatcctggaggtctgtcttagtgtttgtattttaaaaacaatttccccaaacatgttgttctccagttttgttgaagagagatagcatgtgtaaaaatgtatcccttttttttttttttttttttaagacagagtttcgctgtgtagcccaggctagagtgcagtggcgagatctccgcttactgtaagctccgcctcccgggttcacgccattctcctgcctcagcctcccaagtagctgggactacaggcgcccgccaccgcgcctggctaattttttatatttttggtagagacggggtttcaccatgttagccaggatggtctcaatctcctgacctcgtgatctgcccaccttggcttcccaaagtgctgggattacaggtgtgagccaccgtgcccggccaaatgtatccctttaaatgaaatctaaatttgtgtctaactacaggggtgggagatattgggaatgacagcctaatataattgggagagaagagggcaatcatgacctgttctacaaccctctcagctctttcttatactactcatgcattattgaccttgtataagataatagcttttcaagatgtgatcatgggggaaagctcctataaaatattactgtagaaatttatttcgcaaaagtttgatttgtgtgaaatttgttgtgtgtttatcaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcaggtatatcttttcactaagaaacatttgagtgacagtctcagcttttacagtttgattatttatgagtaaacaggatgctgggcaattgcaggtacttattttaagtttgtggataggtgaccatttaaaaatactagagtgcctcagaatggaagccacctttgtttacaaagattgtatctgagcaagatacttctggctcctgggagctttggagtctgtgtttacttgctgcttctaggaggttagggaatcatggatccaggagaatgggttgagtatattaattcttttttattcagggatattgagggtttccctttttattggagatctagaaagacatctaatgtaatgcttaaccatctgtaaatgttgttgtttgtcttttgttctgtgtggcctgcagtatgacattcgacagaaggctttgaagctcacagcgaacagtatgtatggttgcctgggattttcctatagcagattttacgccaaaccactggctgccttggtgacatacaaaggaagggaggtaaatggcgtaataacattcacatctctagatatgagagtatttttaactatacatgttatagtgtgggagagtcaagtttattacctagttgtacagcatcaaatacagtacccctctctttggatgacaggtttgagacaaataggcatttaaataaggtttcattaattcgtgtgtgtgtgtatttattattgaacatctactgcatgccaggcattgttctaggttctcaggatagagtgtcaagcaagacctaaacgatccctgttatgaggcttacattctacccagaatgggaggggtttggggttggggacgacatgggttgggaatgtggggtggtgagagggtggtttgggaaaacagactttaaataagtaaataaacatgtataagaaataacagaaaatatgatagaagtaaatgctctgtagataattaaaacaggatggtgggctagagaatgtttggatggctggtttagattggtcagggaaggcttctttgaggaggtgacatgaatgagaatgacttaagagagtttttttttgctgatggattagcttggagtgtgagtgaaaggtagaaatcaggaggataactagtagagccttttactaagatggaggaaactgggaaagaaggattaagaattctgtcatggatgtgttgcctttggcatgagtaatagaattccagacataataaggaggccattggatgtatagatccagaattccaggaatacatcaagacaggagttatggattgagagttattggctttaataagatgggccagataccaaatagaatttaggtacatcactttatggacactgtaagcttcaactgttttagtactatgtgcatgggtttttcttaatttgtaaaagaatagttacgctgaatattaaattccatttaactccctgtctgtgggtttaagactatttagccttaaaggaggtaggtagtggtcatgggaaaaatgcttatattggggggtctgtactctgaatgctctagagcagtggttggcaaatgatggccatcggggcaaatgcagcctgccatctatttttgtaaataatgttctattggaacagagctaaactcatttatttatgtatcatctgtggctgcttttgtattacgagagcagagctgagtagaaaagatggaggctcacatggcccgcaaagcctgatatatttactctctggtcttttttagaaaaaaagtttgctgacctctgctttagagtttagatcaactctgtccagtagaactttatgatgatgaaaacgttctccatctgcactatccagtgctgtagtctctagccacaagtggccagtgagcacttggtatctggctggtgccaactagctgaggaactggatttttagattgctttaattataattaaaatgaatttaaacttaaatagacaaatgtagctagtggctactgtgttggacagtgcagatctagctggtatatgaaataaacgtcaggatgttcagaatcactcttctgttggcagccgtatctcaaagatttgtcttagggcacagtgaggaagggcaaaacatgtattgaacgccagtgatgtgatagaagctttcctatgcattatttcactgaaattacacaagaatcctttgaaatagataataacgttttcattttttagatgaggaagttaaaactcaaggagataaagtataacaagtggttattttgaatgtaaatccttttagtacagtagggttgtctcttccatctcaagatgtcatttatgactctggttctgctttatattcgacctcttattacaggaagatcatgatttttggtacccatctcaagacacaggtctctttttacatgagaaagatataggtgttttaggggctagttgaagtgagggaagggaaggatgctttcagtttcttaagctaagtttactttaaaattatttaaattttatttctttacaagtatccagtggcttctgatggaataccatcttatttttgtattagaaaatgcactcactatgccccaactgggtgataatacatgggttgactattgagattggatcaaggttactcttaagtttctcacgagaggcaatagttgacaatttactcccttggagagtgcctcttgctgctgggaaatccctgttgttacattttccacattggctcagaaatccacaagcttaaaagggcactgttgataatgataagccccaaatttgtccaatgatctcccccactctcctaatccattggattttaagggcaatggttttctttagctggatttttaatagcgagtttaaacacaattttaatttttctgttatataaaatataacaataacaaatctttaataaatgaactataaaaaaccctgttctctccactaaaaaacaaaggatttcagacgaatctagaactacttgtttgtgatttaaattcttggtatctgctttcctcttttctctttaccctttgctgtttccctcaaataaggataaataaaactctggaaagtaggcctttaaagtaatatgaggctactgagaaataataattacgcagtttctcccaggaaatcttattctagaagaagatccaaagtcacttacaaatattatttcctaatataaaaatgatttttaaagtattggtgataattgttagcactggtggatggaagtagtctatgtgatatctttctttgggttagcgtctcttaattattaaagaggtaggaggagtgaagtgaaaatgagagccagtgtgctgagattttggaatacctttgtaacttattaaactagtattttttgtgacaagatacgagtgggcagaataatatagtaacctgcagatcttacaaattctttgcttttaaagtccttgtgggataaattagattaagtttcaagtggaaattaatgagaaggaaacctggtagcatgccattgcaaaagattataaaattttgcatttggatgtggattaatacacagcctagggaggccttgaagcccccttttcctttttatttttaagtctattttgtgtttgctcagttttcctggaatcgtgcacgtttggctctagcgacctaataatttctgtaatcaaatgtattatggctgctagaatactcagagtaattactaattgtactttttaaaacaggtttataataaaagtgctagtagttgtgtcaaatgggcatcaatattgtcttttcacaggtgtgatctttcacgcttaaactcttccatgattttgaattgctttgtggtagaggaatgagctaatgggtaaggaattgtatgagggatctcacagtgtgtacgttatttaaaagtaatgaagtcagtgtttcagagtactctgtggatctatagaaataccatctgtatttgtgtttgttctcaatgtgtgtgtagagaggcataaaaaagaaattgggcaagcctatggcactgagtggacatatatttttaaaccatgaagaaaaggggtatcagttgtcaaatgtctgatgtggtaattgaagtgattgttcactagatggcgatagacaccctgagatcattaatcaattaaggattttattctgtgaacaatagtgaaggcaatttaatgagttaaatctgtccacattttagacttttattaattttggaactattaaagaaaagctaaaactggcccaaaggattgtaatactctagtgtttaaaataattatgattttttaatcattagttatattgataggaacagtaatttatcatagcaagttaattcttctatcgagtagctaaattctgatttctggccatggagacacgatacatgactccctcagtcacagtatcagaagctaatctaaagggaattggaaatgattttgatatatgattttgcctttttgaatttgtttttttattgcgaaattttttattttattttattttatttatttatttttgagatggaatctctctctgttgcccaggctggagtgcagtggtgccatctcggctcactgcaagctccgcctcccgggttcacgccattctactctccctcagcctcccgagtagctgggactacactacaggcgcccaccaccatgcccagctaattttttgtatttttagtagagacggggtttcactgtgttagccaggatggtctcgatctcctgacctccggatccacctgcctcggcctcccaaagtgctgggattacaggcatgagccaccacgccaggcctattttattttattttattttattttattttattttattttattttattttaagaaacagggtctcactttcttgcccaggctggagagcagtggtgtgatcatagttcactgcagcattgaattcctggactcagacaatcttctcccctcagcctccctagtagctaggactacaggcatatgccaccatccttggcaaatttatttttattttttgtagagatggagtcttggtgtattgcccaggctggtctccaactcctagcctcgagggatcctctcaccttggcctcccaaagctgtaggattatagataggagccactgtgcctggctttattggggaatttaaaactgactatgtacttataagtatactcattgcataactttagtttaacgggaatatttgtcttgatggaataattagtacttactgacattggtattattttatttctctactctcttatttctgtgtccttgagaaagccatttttggtctggattttttattgcattttaaaatgtatgctctgatgtttaggtatagagtccatgcattttcattttcctacctgataggctgaaataagctttgccagcctgcttgccagttggtcgtagactgcctggcttttagttgtgttggagctggaatttgtgcacattaaaagtgtatccaaatcattaatgcaaacattacaatcttggcaagcctttctgggattttcttggtgatgtggtagcacctatcaggatcccttgggaaatggcactaggacagagggctctagcctttgttgatgttggtgatgaaagagaatgagtgactatgaagaattttacaattaaatattaagagaagtctttcatctttacctgtaaataaccaaaaatttcacttttgcaatctttttctttctttctttctttttttttttgtggggggcaggggggcagagtttcactcttgttgcctaggctggagtgcaatggcgtgatctcggctcaccacaacctccacctcccgggttcaagcgattctcctgcctcagcctcccaagtagctgggattacaggcacgtgccaccacactcggctaattttgtatttttaatagagacggggtttctccgtggtcaggctggtcttgaactcctgacctcaggtgatccgcccacttcggcctcccaaagtgctgggactacaggcatgagccaccgcaccccgctgtgatctcttaatagcctagtttttctttaaaaaagtaaaagcaataaaatattatagagacaactaaagaccatttcctccccatcctctctcatttctttttctttttcggaggtaact

SEQ ID NO: 136646 - DNA, 7808 bp, Homo sapiens
atacgtaactccctcagtcacagtgtcagaggctaatcttaagagaattggaaaggattttgatatacaattttgcttctttgaatttttgtttagttctctgttgaggcattttaaacttactatatatatacttagacttgttgcataatccttgatattccacatccttgcagcacttattatctgagtttttattttttggtcagtctcatgggtatgaaagggtatctcattgtgattttaatttacattttaaaattattagttaagttgggcatcttttcatgtgtttattaactcttccattttcttgtctgaatagaacatagatgttctattttgttggattgtatgtctcttagtattcttaggtattcaaaagccaatccttgttttgtcatttgtgctgcagagatctctttcagtctgtggcttgtccttttactttatttgtagtctttcattatgcagaagtttctaattttaatgccagatatttaattttttcctccttacactatgtgggtttttttcccacaagaaagctttccctcctctagtgacgtagacattctcccctgttttcttctaaaagttgcaaggtttggattttcttatttaggtctttaatccttctagaaattatttttaggaatgatacaagttaggaatctaattgtacttgtttgcttccttgtagagttattgaacgttcctgtattgttcctgtattccaggggttggcagactttgacccatgggctaactcaactcaaaactgcctttttttgtaaattaagtttgattgggacacagccctacccatttgtttatggctgcatttgtgctacaacagcagagttgagtagttgccagagatactgagtgaactccaaagcctaaaatatgtcctatctggctctttacagaaaaagcttgcaaacccatggtctaaaagatagtcatgaaagagtagctcatatttccaacagtagcagatatagtcagtgaaaatagaggaaattacactaaaggttgtaagaaggaaggaaaacaatcttttggacatgtaaaaaatacaaagtttgggccgggcgcggtggctcacacctgtaatcctagcgctttgggaggctgaggcgggtggatcacctgaggtcaggagttcaagatcagcctggccaacatggtgaaaccccgtctctgctaaaaatacaaaaaattagccgggcgtggtggcaggtgcctgtaatcctagctactcaggaggctgaggcaggagaactgcttgaacccgggaggcagaggttgcactgagccgagaccgcatcactgcacaccagtctgggcaacagagtgagactccatctcaaaaaaaaaaaaaattgaaattttactgattcttagattgtcatatgagaacttccctcaacccaagtagagtaaaggggaggtctgtgaatcctctgaagttgtatgtaatattttgtgtgtctgtgcatatgtgtacttttttggaggagaggatgcatagcatttaagagactcaaaggggaccatgatgtgaaaaatgataaagaacgctggttcttatgtttcatttctggcctcttatgtaacttgaggggaaactttagccttaaaaatgtatacttttgtcacctaaaacatggcagtgcgaagaattttcttgccaaaccagacccatttaaactgtgtgggtggtaggagggatgagttctaattctgtctccagaatttttatagccaccattaagactacttttaacttcagctgacctactaacattttgattttttttaatatgagaatttcttttaaggctaatatgaaggtttaatgtattttggcagacatattttatgttaaaaaaaagcaatatcctttgttagtgatcatgaattacctatcactttcaaagttgcttacattataaaatttgaagccagataatttttaaatttcgtttctattgtcatatttcagggatgtttggattctaaattcccggcagttcttcagaactgataacacatactattcagctttattaattcacattctactcatttagaatttgtggtaattcagatggaatgagttgaaattcttcttagtacacattaatagttatttcagagcctaggttcttttcatataccattaaaaatacaggttgagtgtccctaatctaaaaatctgaaatgctccaaaatctgaaactttttttttttttttttttttgagacagagtcttgctctgttgcccaggctggagtgcagtggtgcgatctcggctcactgcaggctccacctcctgggttcacgccattctcctgcctcagcctcccgagtagctgggactacaggcgcccgccaccatgcccggctaatgttttgtattgttagtagagacggggtttcactgtgttagccgggatggtctcgagctcctgaccttgtgatctgcctgcctcagcctcccaaagtgctgggattacaggcatgagccaccgcgcccagcccaaactctgaaactttaagtgccgccatgatactcaaaggaaatgctcatggagcattttgtatttcagatttttgaattagggatgctcatccagtataatgtaaatattccaaaattccaaattcaaacactctggttccaagcatttcggatactcagcctgtactgtagaaacaactatctacatttaagtaagtggcattttatctgcagatcgtttatattgatgaacttgtactaaggaaccatctgtttgcttgtccatttgtctacattctttcaaaaattgatgaaagtaatgttggtactttcaaataaaggtgaaaaaaggaagctgtaatttggaaacaccccatggaagcccagtccagattataacttagactttcagtaatttgagagaaatgcgatgataaaaattcaagtatatagaataatttatgcttatatatgcttgcattataataaacaatatatacttatatgaaaaatatatggtaagcatataatatatatgttatatataatctattataacagtgttgcatttatagagattaaataagtgggttacacttaggcttgattttaattactctatatgcttgaaaatactgagtatttctttcaaaatggctaagatgttagacttgagacaaattcagaataaccttattcttctttcttaatagttggaaactagcatatctctaagatgcatggatattggcctctgtgtgccttttaggtttttggacattgaaaggtacaggtttaggaggacacaagccagttgatgtaagagacagctgggaagagaaagactaggtcaaatcttgcctggggtctgtgagtgtaagagaagaaagctacatcaaggaggccatttagccatcttttgtttatcccctttgcatttgctgaagttttttgttttttgtttttttgtttttttgtttttgagacggagtctcgcactgtctcgctggagtgcagcatcgtgatcttggctcactgcaagctccgcctcccgggttcacaccattcttctgcctcagcctcccgagtagctgggactacaggcacccgccaccgtgcccggctaatttttttgtatttttagtagagatgaagtttcactatgttagccaggatggtctcgatctccttggcctcccaaagtgctgggattacaggcatgagccactgtgcctggcctgcatttgctgaagtttttgagtggtcaccacatcttagttttacctgtgctttaaggaatccaggtgtgggcacccgcacccctctcctacacatacattatactactaagtgtcaaaggtaataagatatggtcctggggttgtgagttggcctttccagtcttgctgaatcttcagtcaatactaatctttaaaattccagggcttctttcatcaaggaagatggaatttccttattctcaatccaaatttgtgcctttttccacccatatattggatttcttattactagatttttcacatgggtctgcataaactagtatcaatacttaaaaattttgtattaacacaaaacaaaagtctgcagcctcaaattatttctgtattctccaacctctacttcagtttgtcagggagtgcatttcagatgtttttttgttctacctagcccctaagccctgtgctctacatagtggatgtttgtttgccttacctctgggatcacactcacttggtagtttctgtagttatagatgggtagatagggaagtggtatattttttaaagaaggtcttgatatttaagcctattttgaatttataagaatggccaggatactcaaacaagaaaaaggataattcgtacatttgtagtgggaacctaggaacttttatctgaaaagatagggacagagtatttttgccttgtaattttgcctttttaattactgaaaccattgggaatgtggctaaggatgagaagataaatgctattaagactgaccttgtgtcagcaccactgatctctgctgagatagattaagtttcattactttgactagaatcacataaattgagtcctggaaatctttttcttccccacccctcaccagaatgagtgactttgttaacccaaattcattccatttttctccatatgtgaaaattttaaataaacctattttggtatctatttctttttcacaagccatgtgttatttgacaggtgttttgaagcccttgctttggcagtgaaccaagatgacagagcagtaatgatttggaaagtgccattccctccttgttaagcgataaaaagaaaagtgtgaagttattaaccactattcaccagtggcatagaaatcggtataaggtttaattgtctggttctacagttggtctaggtaggcaatttcctggatagtgcttctcttaaggaaagggaagaataatcatataacttcacttttttctcccatataatttttttttcttcttttcacaaattgcagatagatggattggagagaaaggatcactagaaaaccaaaatattgacctcacaggctttccctttcctcatctgcccaggtatacatttatgggtgacatggcagcactcagcaacattgcaaatttcccaccccccaaatgaatcacatgctcaagtgtttgaatctgatggtgtacaggatgttaccacactgtctccttatgttagccatgctgagtctatttattgctaattggaaaaacctacttttggcagcctcggctgcctggtggctttagcatacccgtcacaacagtatggtcagacccattaaagacacatccctgtcaaatttagaaaacaaaacaagctcattgggcttgttatggctcaggaccagctgactgagggaagactaatagaattagtaccttctgtttgtgtgttatcattgcagtgggcagcatgagcctgtgtcaatttgccagatcataaatactgtgttaaattacaatgaactgagattggtaagttgtgggagttttggaaggcggggagaagaatagttttatgtatgtgtgaagaagccgtttgattttcagccagggattcctgagccctgtggtcatggttttagagatcttagacttactttgaaatttagtaccagagtcaggttgtgcagctgtccttgtttcctttttattgttaattttgtggttgaattggcttgtatcccttttaaacttgaatgtatgagtctcaacattaaaattttttctttgaaaattctgttttaaaaagcaatatgaaatagaatgtagctgaaaagtgaatttttactcacatttttaaaagagcaacaaagcatgagtgatttccagaaatggtttctgtgtcatctttggaattcttctaattactaattcttctttataggcttgggtttgattttgtattacctgtttttattggctttgttgttttacatttgacaaaagatttgctgttttgaggctagtgatgagattgatttatttatttttttatttattttgccttaggactaagagttgagcggagatgggagtggaacaaagatattaggtttcttttatgatttggagtgtcagacatttggctatatttgtttcatgggtttttcatcgctgctgacttaaccacagacgacattttcagccctgtgcaggagggtggtgtgccttctgcaggcagggaggaggagggttggggtgtggtggcttagagaaaggaatcagctcatgggctattaataatgtaaattgttcttgaggccacatgtaacatttctgagccctgaccaacagggtagggtgcgtgttctatttacattggactgcatggcacgatgtgatggatagctgataatcacaggaaaaatccgggtatttcttctttaatgatgtcctgatagggcagaaaaaaataatttgtcttcagaagattggcttagagtggctgaatatatttaattcaattactggttcttgcctcatagccaggaattcttcaagtgatatttgctgagtgtgtacatggagggaaatggagacaaatgacattgcttgtgacccactgccttgagaggaaagccttcggtaatgattccagtaaaactagagctagagcttgggaagctaaacttgtgattacttactagtaaacaagagaaaggacctgttgtaggtgcaaaaatcttactgaaatgcctgagtatgcactggagaaagccctggactgcacaccaggggtgctcacccacttgtttactttttgtggctttgagcaagtcatccattctgcctttggtttttcacttgtcagaggggtgctagatgatgataattactgctcagtgggcttcagttacaaagcaccttaacatagagtagctatctactgttgtttctcagaacaacccaggggaagcattcgtgcaaggctccgagtacctagcaagtgtcaggcatgccacgtggtgctgctgttagggagacagtggtaaacttaagcattcaaggaccttgtcttcatggagtgttcagtccattaggtgagagctgttaatcaaatggtcaatgaataattatgtcattctgaaagaaaataagtgctaagaaaaggcacatgaatttctgagtcttgatagcaaaggcccttgacctggactgaaaagtcaaaattttcctgatcctttggtacttgagctgagatctagaaagtgtgggctggagttaactaggtaaagagttggaagaataagcattctagagtgagggctagcatgtgtagaggtcctgtggtggttggaagcattatgtggccagggcactgagaaggctgaggtagctgaagtatagaaaggaaggggagagtgataggaggcaaggctggaggggtaatcaaggtcacaccatatgggctttgcaggccacgttgaccaagaggcagatgttaatagttttttgggtttttttttttgaggcagagtctcgctctgtcgcccaggctggagtacagtggcatgatcttggctcactacaatctctgcctcccgggttcaagtgactttcctgcctcagcctcccaagtagctgggactacaggtgtgcgccaccactcttggctaatttttgtatttttagtagagttggggtttcaccatgttggccaggctggtctagaactcctaacctcaaatgatccacccacctcagcctcc

SEQ ID NO: 136647 - DNA, 9002 bp, Homo sapiens
tttatatgttgggggagattggctcacatttccattttgagaagatcactttgcctcagtgagttggaggggccagagtggatgaggggaaactgattagcaggctattattagaatagaattccaggcaagtgatggtggtagcttgactagtgtgatggcagtcagtggagggaggaggacccagatatgagagagatttaagagaaaaagtatcagtaaaactgggtggtatattggatgtggggcttaggatggggaaggtatcaaggtcaactcttggctgacttgtgtaggaagatggagtacctttcactgagatgaagagcactggaagatgaccaggtttggggcaggaggagggaaagatgaacagtttgatcgtagacatgttaattttgaggttgcagaatataaactggggagtcattggtttatagtcattgttaaatgaagccatggacatggatgagattactttgggagagaggagagagtggaaagagaagtgggtgtaggactcagtcttaaggaaccccagcatttaatgacttggtagaggaggacaggctttaaaaagtagaccgtgaaagagcagccagagaatgagaagaggtgggaaaacatggtgttgtgaaaccagtgaagagcatttcagggaagtagtaggcaactgtcaggaagagacactgatgatagttttgaaaaatttccattgaattttgggatatggaggtgatcttttactttagttggtgctgtttgagtgcagtaatggtggtcagactgatttgctataggaagataatgtaattatccatagtttatagatcaagaatctgaggcacaaggaagttacttgtaaaacagctcacctaagtgtcagaactggaatccaggctccctgttctgtatacctgctacctacagcttactgctttactaggtgagtgtgtggactgaagaggcaaacacagctgtgtccctgttttgcttctccctgagttgggatctattaactagttacttaacctcattgaccctctgcttcctcatttttaataatggtaaatgcccggtgaggttgttgggaaaattaaatgagataatgtgtgttaatgccttgaaatgcgtttgatacataataagtactcagttaatgctagctaaaaaataaacaaccttctaccgttctgtctgccctctcctcagagcctcttacctccaattacatttttctcttgtttaatgcttagcagtcttctctaaaaaggccagtttgtatgctatttgcccagttatttttcaagtttgtgtttttactttgccatttctcctgcttttagtgcctttgtccacctacaccactaatttctgtgtagtgtaatttctgtcagtcttcctcaaaactcactttttatgactgatttaaaactgattttcttcactctgcaacttaatgagctcagcttatgtttacatttgtttcttcttaggagcttgatattcatgagtttgcgaagtttgttcactcagttttactaaatagattcaggggccaggcatgttttttcatgtccttcagcaacatgtagtagaatgctttaaagtagtgggtacaaaatggcaaacagtatttttatgctatttaagaaatagctctttcctgtcactttcttctcattacagtcgtaaggtgcagttattactaagtcctgccagtgttacttccaaaatattcggattaatccatttctctccattgacactgccactgctctgattagtttagaccaccatcatctctggccaggatcactgcatcagcctccctgtggtgtctcccttctactcttgtcccccccaatctattctcaaccctatatttttaaggtgtaattgcatcatatcattctgctttgattcctcattgacttcctatttcagtttaccttggactccaaggtcctacgtggatcacttcacctctccttttacctcatttttgtgcctcctacctgctgctccctcacctgcacccctgctttagtccagccacatgggctaccctgttctttcagttcttcacacacatgaattctgtccctccatagggaccttgtgcatctggtttcctctgcctggaatgctccttcccaggcttggtgcagggttgtatttttctctcttcaggtctcagcttatatgtcaccttcttgtgtgtgcgtggtgttttttttgtttttttttttgtttttttttttgagacagagtcttgctctattgcccaggctgaagtgcagtggtgctcttggctcactgcaacctccacctcctgggttcaagcatttcttgtgcctcagcctcctgagtagctgggattacaggcacgcaccaccacacccagctaatttttgtattttttgtagagacagggtttcgccgtggttggccgtgctggtcttgaactcctgacctcaggttatctacctgccttggcctcccaaagtgctggaattacaggcgtgagccactgcgcctggccttatgccaccttcttgatgagacctttcctgactactctttctaaatagatccatccagcacaccgccatctctcatttttaaataaaaaattttttctcactaattttatagggtgaaatatacccatgtgccaattttccagaattaatacatgttaagattttgtcataattatttcagattttaagtaaaagagagcattacagatagttgaggttggtaatgtgtgcccttccccagtttcctcctttcctctccagaggcaactgttatgaagctgatatgtatctttcctttttccatgtttttgttacctatgaatgtgctcacttaatttatgtggatggtatcttatcatttttcagtttgcaacttttttcactcaacattatatttttgagtgatatccatgttgatgtatacatatctgatcacttatttgaactgctgtatagtattccatcatacaaatattctacagtgtatttttccctttctcaagtgatggtcatttagattgtcgtcagtgttttactgttatgaaaagtaagcattcctctacttgtctatttgtacacaggtgcaagagtttctctgtcatgatcttttctagctcaacaccctgtttcattcccattttggcactcatcattttgtaatcactgacttatgtgtttgcttgtttatatacatcttccttattcagctgtgagctccattggggtaggcagtgtgtttaactcactcctgcaaacacagcccctagcatagaccttgacacatagtaggtgcttcgttggtatttgttgaattaagtcagctacctgctttccatctgttttgtgtagttcattcctttggtttttgagctttggttttcagatttctgaagaaaggtgaagactgatgaggtgagttgccaaattctatggatagtgattataggtgattaggtaaacctggcatgggaaggagctgaggaaaaaaagctataaataatttgttttggtttaaacaaaccaaaatctcaaaatttggagatgatggttggcaaggaactatgtgtactagttttggttattgaaggagctgggtttatcagctgtgggctccttccacatctgtatcattgccttattattataggattttggagaggggtgggaggattttgtgtttattttctaaaattattctatgtgaaaattagaaaattagaattatggtaggtgtaggagatatggatcgtagattaaaaagcatgagaagaaattgggctgttgatcttaaagcaagattgtttaaatcaattagttttttaaaattctcctttttattagagttcactgaatcagtgcatgtgttctgtgttttctgtttgcttttgaagctgttcagtgttttccttaccatcatagacttcagatttaactacttgatgttcacctactgaattcacatgtagagaggaaagacgaattcacgggaacaaacggatttcttaaaatggagattgctgctataatcacactttggacctctattctagtacaggacatctcattttatccactagtagcctgtgtaagccatttgctgataaattgaatcactgtaattatatttgaagttagctattggaggaaaaaatgtagctatagttaaatactatggtaatgcctcctaatttattctttttcattttggagtatactgtttctcccctcctccactcagtttagtgtggcacatttgactgcccgccccccttaggttgggtatcagttatgaacttccagagagaattaggatctggtctcactgtctcctttgcatgtaaatagtaaataattagacatgcagttaaattggagacaataatagctgagatatattaagcatatgatcctgttagacactgttctaagcactttatatgaatagtaaacatataagcacagtccaaaaaatttttttctaactgtataaaatgtaggagtcatgttattttgaggtttatgagaaattgtaatcttcaatttctagttagtggaggtgggcgtggaggagaaaatgtttgcatttattacatgtgtagaaatgtactgaactgagaaaatctaaatggttacaggctagtcatttcttagtatcctgcctattactcatccactcccttggtaaaagctttaccctgttcctataagtgggagctgggtggaggatgggaagcaatcctcaattgagttagatctgactttgcttgattgtgtggcaagttagtatggggttttatgtcattattttatttcccttttatagttgagagaactgaagtacagaaagtataagtaacttgctcaagatcacagagctagtgaataaatggagccataattcaaatctaggcagtccaagcattcttaactgccacagtacattgcctgtgtttttgagtatttgcctgtgcaacaggcattaggagatgggagaaaatagtgttgtatcttcacagtacttggagccatttttgtttgaaaggatgtgtactgtattagtgtgtgtcatcctgggttggttagcatttgctgccactttatagattttctgagagcttcaattttccttttatatttcctcagtcttttgacagcagtcataatggaatttgaatggtcatagttaatgtggcctttggaacagaattcttaaggaagaggattgggtgatgaagcaagggtggtaagatggggaatgaggaggaattctttctgtcgtatgtattttgtggaataaaatagtgatgccatgcaccacagctcaaacttggcatggttctggaagatgtctttgtgtagcctgtctgtaccactcaccatctgttataatggtgaaggtcataggttgtttgccttaagcagaataaacaaatagatacagaaaatgtattcagtaatctttgcttgatgagcagaagctagcagttgtttaaaacaagtgaaggggataaaaactcccctaacttttatttaccaatcacatcgcaaagcaaaaatagcctatttttaggctgaggctccaattatgttaagccttgaagataatgaaacagtctgacacaaaagagtgtggtgacgcaagtttgtgtggtgaaattccaagacactcactgactttttaggattctgcacggtgaatattaagctcctaaagtgtttgttgcccggaaacagcgctttattcttttacatgcagtgtaatgaagtgaacctgtgttgtaatttgtttcttgcaaggaaaagggagaattaacacacattatctatctttgtgtcctgtctttggcctcttgtgtgtcccttttatgtgctgaagccaccaagtcatgctattgctaatactgcatattaccttctgttttagccactctaatttttcttaatgctttacacagtaggggtttccagtttttcaactaattttgtattgtagatttcaccgaatttggagggtttttcttttctgtcactttttcctcattctatgtaagaattactcttagcttttggacccgttcataatcatgtcaggtgatgtttttccttggaactaattagtttcgggggtttgaaatatgtgctggcacggggtttcattggctggattaatggaagttggccatttgtgctctcccggtctcatgttgccctttctatttacaggttggtaatgggcttctgggtttttattctgctgcctgtagtcttcttgaaaatgaacctgaggtgctgaattctcatgtgatgggaagtgtaatgcttccttccagggcagcctgtcttcttaattcctgaatcttgctatagcctaggtcccaaggaatcagattcctagagtcaggaggttggtcatcttccatttggtctcagaattttcctttccaaagagtagtcataagaactaaatgtgggaaggcagaaggaaagacctatcaacatcaaggtgccaaagttacaagcctctggcattggtggttcatggcaggatttgatgaagttggggagggaaggggacttgaaggggataaatgaactcctcattagattcagattgaagtgcactgatgtgacctgtggaagagctgaaaacataaaatagcactcaggtgattgataaagacagcctggttggatgaagtggaagctaggaaatctctggctgggtgcctgctatccacgtacagtacttactctatttcatttaatctcctgcagccctgcgggtgggggctcttatttctttttacaaatgaggaaaaagtcttgaagggattaagtaaattgccaaggcctctttatttgtaagtggctaaaatgaatatggcttctcacatttgtgccactcttctgaaatacaggaaacacagacatcaacagtatttatctttgtatgcttactaaggaaaatactgtgtggtacaaccactgaaaaggctataatagcttttttgttattgcactttaacagagagctctttcttaaaattacagatttttaggaccaaattcagttcagtcgtctggcctactatgtgccaggtacagtattgaatcctggggatatgaaggtgagacagaccatggtccctggtccctgattatagtctgagttgggagtagaggtggagggaaaggaaagaaattgccctgtgaacaaattccatgccatatgactaaggtaaatttaaagaaaaaaggaaaggtaaacattgcctagagattacagaatgatgcccatgcccacagaatatctcttactgtgagatccattgattctttggtcattgccaggatttgtccagagaggtacgggatgtcgtctttacagggtgaagcccaagaggaaccatattatgttacaaacttgggggcttttcttttctagctagaggtctaaactcaggagggtaaccaagttttttgttttgttttgtttttggtacacaaagaatcttctgtttctacatccagtaaactttttgttttcttaattttaaattgtcctcaggctgtacctttccttacccccatctctgaccaagaagggtggcagggaaggggggttctaattccaactcagctactaatttaggaggtgaccgataacctctacagttccatctgtcatagtgcctttcacataactggtactcaataataagtgtttgccatgggacaacagaacttgaaatcttctgtgattaatttgtattgatttttggggggcaggaactggaagggggttagttttttttaggatgaaaagttgctgcctcacattccataacagtaacacaaattatggataaatcattaagtataaatcacaactcaagataagtgaaaaaaattttcaaatattgaagagttcttttataaattccatctcctagtgagatgcattacatctcagcccagaatgctgaaggttcttgtgattcctagcacagtgcctcatctttggtgtatgatcagtgaagaataatacaattatgaaatgactactagtaatctctgaggacttctgaggataacaggtgttctgaagtttgccaaacttggagaccaccttcccttcctagaacagatttctaggaaaagtcttcaggtctttttgatcacaatacgataggaattgtagggaggacatgaagaaacaaaagatcagtcagaatgtttcacacactctcaattctctaataaacacagtactaagcagtacctagacattgctctttgcctgaaggtgggattctttagtacctcatacagtaaaagatggtgaacctttcagtgctttttttcagggcaaaaacagcagggtcatcgagtcataactcttgtaatctgggatgcaagttatgtaaccatgtcaggattttcttgagggtttctgtccagaagatggaagacaaggagtgttggttgttttctaaacagtgaactctagaaatttgtagatgaatgaactatacaatacaattctagagaaaactgctaagcaatttttcagcactttatggcagtcaccaaggatcattattggctcacccagaacaggtactgttggtattttttttcttttagtcttaatattaggcttaaattagcacatgaaagtgctagttttaaaagttaaaagcagttgaatatcaacagtttcatgtgattcatcctaatggtttttattatttttttctggttataaaattaatacatgttcattgtagcacacttagaaaaatagaggaaaataaaattacagtctaacaatctattttatgcacttccatctttccatgcatatacatatgcacacgtataaatctgttcaccagaatattttcaaaaaacttactgtggattatagttcatttttagagactatctggctgt

SEQ ID NO: 136648 - DNA, 1943 bp, Homo sapiens
gtaaattagttcaaccgttgtggaagagagtgtggtgcttcctcaaagacctaaaaacaactactatttgacccagcagtcccattactggatatataccaaaaggaatataaattgtgatattataaagacatgcatgtgtctgttcattgcagcactattcacaatagcaaagacatagaatcaacctaaatgcccatcagtggtagactggataaagaaaatgggggtacgtacatgatagatatactcatttctgcttttactagcaatgtgtgaaagaacctccctgataaaacatcgccacagttagctgttacttctaagaccaagagaaaaaacaggattgaccaattttgtttttccacctttgataagtttactaaacaaagatatataatttggttttatcgaaggacctgacgaagtttttcatgatatctttgttgtccaatcaaacaatgtgaactgaatgcagatagaatcagggatctcttgtttgcagaacaactatactctggaaaggttttattagtgggttattgtcaactgggagggacaccttgtgtggtgaggcttagtgaccctgtcctgaacaatgttatttacagtgattttgatgaaaacagaacatgagcttaacaggtttccaggtatgccacaaagtgagaaggatggctataagttcttctgtaccatactgtgggctccctgagcaagggagctggagtgctgagagcattccttctggagtcaaactgctacctattagctgtgtggctttgggcagagttacctaacctttctgtgtcttagtttcctcatctataataaaacaggaatcaacagaatatttacctcatgacgtttgttgggaagattaaataagttattaaatgtgaagcactgagagtagtttctggtccttagtaagtgatcaataaagatgagctgctattgttaatctttctctcagatggtagataacacttcttaaatgaatgcctgagtcagtgtcataaatgctttgtatgctggtgggatgggtccatattgcaaatgaaatgtgatgtgtaagttttgcatttatgttttataatattagaaccgtcatgtaaagatagggctgagagttatactgtgtagctccagaaggtagagatacggtttattgataggaattagtgataagatactttctaccaattagctctactcaatagtggagttgccctttcaggtagtggaagaattcaggtacaagcttccagaccattacaagtacataattgaaaagagagggcttctttggctagaggtgagactagatgacctctaaagtcccttccaactctaggctgattctgtgattttgagtggcatatgtaggattatcacatatcatgcaataaggccccacgagtacatctttggaagggttgatgctgctaatccttgcccactctgccctctctgcttcagtttctttcacctgttgtgtgtcagcctgacagtggcccattcctcagcttgattcagttttacagcccagcttagtgtcccaggctgctccctcctcagcagcaatgcctagaggatgagtatatgaaccaagggcacatttttcataagcatacaagaaaatagaagattgttgcctgcaaagtgtatctcagaattgtattttaaaaaaacaagcaacagttttgaccatgccagatgtactcttgtcgctttattcggggccaagggtggactttaccttttttgctcagcagctctgggcactgggtttctctgcttgtctggtttcttgcctaagttcagcatcaatattctaatcccctgggaaggagcagttgagcccacactgttgtatatactatgtgggcttgtatacctttggctgagattatttttctgtcatgaactctgattccttg

SEQ ID NO: 136649 - DNA, 2962 bp, Homo sapiens
atttgttagatgactagtgggattttaaacagatataatcacaccatgtcttttttttaaatgtgatgttacgtacatatgaacttttactgctcaaattttaaattatgtgtttttttttcttttttgtgtttataaaatccattattagcaaatacctcaggaaaactttagagtgaaagtcctgaaaaaattttccactccatgttttttaatgttgtggtttgtccttagttttgccatctggtaatgaatggttgaagtgataaactcctggcaccaccgcattttgctgttgatactagtgtgtgtctatagcttgtggtacagaagcactaagtgaggtccatgctgtacagtgagaagccgaaagagttgctgctctgtgtgccaggtgggttaatatgttttagagaaagcatctgtggaattttacagtggatgttcttttgtagccgtattaattttactccttttgagtagtatcattttaccagccagaatctagagcacgcacatgcattatcagagtgatttgaaacagtggtgtacacacgagcactgtggggatggttctgatgctttcaaggcctagagtctcactgcatatattctgagccagagtgttaatcctactgccttaagaagcctttgcttctccttttagtctttagagtttatgaaaccaacagctttgtagtcttcaataggaggattgtacatagagctctaaagattcttggaacatagaaaccataaagaggaacgtgtctgtgtttactcttgtgttgtgttatatgcacagtgtagaactttttaaaattgaaacaacagaggtagatgatattttaaaagattactaaacattagatttttagactcatctcatttaggctgaaaggaaccttctagtccagccccctcattttacagatgaaaaaatataagtccataaggtcccactgagcctgaatcagggttgatgtaaaacctagaggtcttccttcccaagccagatctggttggatctcaccgctcttgtaactgctatagaacaccactgtagcatttagaaagtactgaatcattatgtaagaaaatgactctctcagtaaaacagtgtagttgttgagtccatagtccaagcaggttttatcgtttgtattaagtaacttcagctgttccatagtcttcagaaagtctgagctgactatatttattttatccaccttttacccagttaacagaatgcttactctcttattgccacttaaaagtcatctggaagactcatgctgataatgtaatgcatggtgaaggaagggggtaaagtaggaaaacataattattgcatgcacggtctttttaaaggctcttttctcctctttttcccagtttagttgggtagatctgatttatatagcattttccccccttttcctaaattggataagagctggaagactattcaggaaaagctataagctatagcaaagcgtgtgaaaagacagtagtttgtgcctttctcaaccttgttatagatctgtggatagtttggagtttacaaaactgtacttaaatattttctttaatataggttagggacagatttctatttgctattgatgactgtcaaaacaacttccctagaatgattgtcacagagcatggggcctcattttctgatggagaaactgctttggtttattctcactgtttttacatgattatttcttattttctcaagtgcttatgacatttaaaaaatctgtggttgagaattgtggcagccagtattatgagaaagagaaactaggtgcctgtaaactatttaaatacaaacaaatgatagcaaaacttaaccaggaagaacatgagtttgaaattgttgatgaacgtgatctaggcctaagacaagctgaaactgtatttctcattcattctttcttaaccagaattgctttaccttcaaactcaagcaaatcttttgtttaatccttgagaattgatacttcagaggatttctttatttcagttattgatggacattattcttaggattcagtactgggtcaagatgtgtgttttttcagcaatgtttgactgaatcccaagctttctcaaggcatatttaaaaaccagtactggtaataggcagacttacatacagttttatcagtttatctctgcttttttgagggagagggagtttcagctaagttgggtttgtgctcgtgaaatacaatacaaaaagatttgaccaaataactttctaatcatccttgctgtatgtatattttggtaaaatcctgctcacagggaaaatgtcttgttaatttttggttacactaaagacattctgagcaactaactttggtgtgtagggctaaaattacttgaaatgctgagattgtattgttttgggaagaacttaagtagcattctatttgtgttaaatgttcttgttaaggcaatggaaaagatattagttgaatatattttttcaaattaacttttttgtctttgtgtttttattttaaaaagcttattgtattgtcttgtattaaaaaaacacataatggaaaatttaccatcttaaccatttttaagtgtgcaggtgcacacaacacaggtgcactacgcaattcactgccagttacagtagagtaagaagtagatatttgcctttggggatcttgggaagaagactgctatctatctctaatcctcatggaatccttaagtggtaggtgccaagggctaaggtgaggggggagaggtggagggagttgtttaatgggtacagagttgagctcctttctctataaagcatttaagcttttttgttgccattaattgcttctatgggctaaagaaactgaaagtgtgggcaggtaatcacttggctactaatataaagaggaagtgaaacaaaggactggcttaatggttcagggtggaa

SEQ ID NO: 136650 - DNA, 2240 bp, Homo sapiens
gagattttttttgttttgttctgttttattttttagtttgttaatatggtgatttataatgattgcttttcaggtgttaagtcaaccttgcatttctgggctaaaccccacttggtcatgtctatgaatactttatttttggatttttatttactaaaacgtttagaatttttacatgtatgtttatgaggaatattggtctgaaattttcttttcttgtaatatctttgtcagtcttggtcagactagggtaatgctgccctcacaatgtgttgagaaatattccttcctcttccattttctgggagagtttgtgtagaactggtattatttcatctttaaatgtttggagtaattcaccacagaaactatctgggcctggacttttatttgtttaaaaatttttaactacaaattcaatttgtttgacagacagtcaagttgtctgtttcttcttgagtgagctttagtataatagtttgtgtctttcaagaaatttgtcagatttattggcacgaagtttttaaataacattccctttttatccttttaatatctagaattggtaatggtgtcatctcttattgctgatgttggtaatttgtgtcttttctttttttccagcgatggtagtcaccctgaactctgtcttctggctcttcaagccagaagaaatgggcatcttgcctggtgcctttcctttttaccaattgtagacatccctccatttttggcaagtttttcgttgtgctccagtgccttcaggtagtggctttttacattgtccagaggttatcaacggtaagaggctatttttgcccagtgctgaagatggcatctctgggttttggttttgtaacattctagcaaagccagacatgctttgctgcagtgaaagtgtggaactggataattgagcagcactgtttattcattgttgcctttattggatctcatatggaataaccccactggatattagagtaaattacagagttaggaaaaggtgaaaaagagaaatgtcgggttagctcttttcaaaatattttcagtgggagaaattgttgtcactttaaaaagtgagctttttaaaaaacgaacattttgagtactgaatatgttaagcttctgaatgattttgagtgcttttgcttgtcatggggaagtttttcaagagaagatgaccttttaggcctaaaaacaaagcatttctaattgcttaatgtgtattgtatcaagtaaattatcattaggtcatattaatgctatgatacttaaatattttatttgtagtggaatccattttctgatcattttatactgagcatttatgccaattttagtatatattgtaattcaaattaaaaaatgctagaagtcatcttaggtctctggatctcagcctggtatttactgagtagctgtcaggagccatgcactgttctaggcacaggaggttcagtggtgaatgaggagcttatattcttagaagctcagaaatctaaccctgttagcacactgtagatggtcagactcacatgtacttgccctaatgccaatttgttcatctgaaatgagaagtacagctgttaattagactggtgaggtcgaactgagagattagtgcattttctctttatagacaacccacatgggaagccaaattacaatcacaaggttgcttggtgagaatggaatcaaaacaaagggacttggatagataatccatgattaggacacacctgccacagagactatttgggttttccctaagtagtgctgagcagtaaagcttgccagtgtctgggtcttcagacttatttttatgctgaccattttcctttgttcacaccatctttttcaaaccaagctgcaatacagttcactaaatgacaagcacattccaggcctgcttcctaagattaaacttagatcacctttggaaacatgtagaggcttccaaattctgagcttaggtacacacctgtagagagtctcttgtttgatttcaacagagtgctaccttagccattgtgcaagtgcgtttttaccctcagagggtatcatttttttcccccttacatccatggtgtgggggaagtgtttgagtcccttatagtggtccccatgtactgccaataataccgttttattctgttcaagtggtaatggaagatttgacttctgtttttttatatgatttactgatgccaaacccttattaaatcagtccccacttc

SEQ ID NO: 136651 - DNA, 1098 bp, Homo sapiens
acttcgtctctactaaaatacaaaaaatgagccaggtgtggtggcgtgcacctgtagtcccagccactcaggaggctgaggcagaagaatcacttgaatccaggaggcagaggctgcagtgagccaagattgcaccaccacactctagcctgggcaacagaacaaaactctgtctcaaaaaaataaataaaaataaaacattatataaaccttttattttcttagcgcctcctaagttataggtctcacaggtaagcagcaatgggaattgaagtagacactaatgtaataataaaaacgtcccagcttctttacccttcagtggatatttgctgaagtgcaacagaaaagataggtgcaggtacactgttctgcactaaacagaaaacacgtagccatcatataaggagaagcgaccgactgacagtaatcttaagatgattcacataattaagatttcatgatgcaaaaattcaggtcagtcatactctcagataaaatattagttaggggatttagcttgaaaaggcacttggcagttggagaatctctcaaatgtatagctgatattaaaaatgtgttatcacttgttaggttcttaagtgttacaaattaattcagtacgataataaatttgctttttctctttctgcttatatattcacattgtacagaatgaaaggaaaaatccagactaacatccaaagactgtatttttgccatgagtgattcagggaacttgaggttttaaggatgtagtatcctataatatattcagtttaactgggacaaaacatccagagaaacccctttgatccttgcctgtgtaagaatggtctcatgagtggctgaatataatggagaggcatatttattgggggtgaccagtactattccatggtgaaggacagaattggagctttgtaggacagaggtatatctggatacatactaaattctagataggtgaagaaaattgtgtgaatttcgaaaaagtgattgccttttacaaaaaacaagagcaaagtaccacaaatactggcagttgttacattagtgtgattctgtatgattgaatgtatgtttaatccctttttc

SEQ ID NO: 136652 - DNA, 1052 bp, Homo sapiens
gggctggacacggcttcaaatactgccacatctgcttgtgatggcacatacccctcgatgtagctcttgtccgccaggtaatcgttgagcacctggaggccggcggggcttttcaggtctctgaaacccatggtgtcggctgtatccgagagctggggagcagcagaaagagcccacttttactacttctgttctacatagtagtggaagtcctaggcagagcaattaggcaagagaaaaaagtaaaaggcatgcaaatcagaaaggaagaagttaaactgtttgcagatgacatcatcttatatatagaaaaccctaaccctaaggattccaccaaagaactgttagaactaataagtgaattctgtaaattcggaggatacaaaatcaacatacaaaaatcagttgtttctatgcactaacaataaactatccgaaaaaagatattaagagaaaaatctcattggcaatagcataaaaaagaataaaatacttaggagtaaattaagccaaggaggtagaaggcctatacattataaactataaaacattgatgaaagaaagtgaagacacaaataacatggaaagggcctgtgttcatggatttttttttttaaggcctttccgttaggtcgggtgatatgtgtaatgttcacagagaaagcaagtagtccccttttttctatatgcattttagatcttctttgctgaagtaacagcttgttataagcatgagtatggaaaagagatttttattcgtatttaaagaacatcagtaataaaaacatttccctagctatgacaaagaacagcctttgtttaagggttaggtatgtctaaagaagtgactcttgttaagaactaaggaataaaatataattcatcttatcttgtgtagggaaaactgtcccaacttgaaagccgctgagtgcctaatttacatttaaagctgaagtaatgaagcctttatttttttgccagaaactcccatttctctcccaaatacattctctatcaggaaaaaaagctcattattttgcatggtaatgtgt

SEQ ID NO: 136653 - DNA, 1932 bp, Homo sapiens
agcgattctcctgcctcagcctcccgagtagctgggattacaggtgtaggccaccacacccagctaatttttgtatttttagtagagatggagtttcatcatgttggccaggatggtcttgaactcctaacctcatgatccacctgcctcggcctcccaaagtgctgggattacaggcgtgagccaccacgcccggcctattgtattgttttttaaaatttatccctggaattggtttgtgtttttattttttaggaatgattatatacattgaccttgtgccacatgcttcagattttataagaagtaagctgggatgttccaagttccgtgttgcatagagttcttatccatgaaaaaatgtccaaaaagatgatttagcaaatttaggattatttcatcctaatttggtattctctatagtgggagttttagagtgtttcttgtgataatcattatagttaagatttattgaatgtttactcaaaaaagttgaatttttctactggttttgggactacttgggtgagatatgtgaaatagattcaaatattgaaatattgaggtactcttataacagaaaatatcaaagctactgccatagtttattagaaatcaggagaaagacttttttttattgttggcctgaatgagctgaagttcagagtaagactgtggtcattattcattacctcttttttttcaaacactaaaactcttgggtttctgtggacaaggctgctttttaatggcatgttctccaaacagctgttaagcacccccctccccaataccacagaccacatctgttcccactgttgattagctagagggtggagaaaagagaggctgtagcatgtgtaattaccagtaattaattcttgttgagcctcctcatttccttctattctaactacacctactcttcttcctgcctctgttgtaaattctgtttcatgttagctacttgtggaaaataatcttgatggttatacagctgttttcctaaaattttatattcacctaacagtgaggcttttatttttcttctggtggcagaatcatttaataaggcatgccaaataagaaaataccaaagtaaccaagcatatctcttggggctagctttcctgcttatgttcttttactgttgatactatttccaactgtcaagaaattatttttcagatatatcctctgttaaaggaactattgcaaggcatgatttagtgtgaggaaaacaaacgtaagacacggtcctggtcctcagtgttaatgtgcagtgtatggaaatataactatgtaaattaacatatattaataatatagtaatttccaaaattgtcaagatcataaggtggaggtagtcttctactatttttcattctctttgggataaagttgggctgacggaaattcaactttgagcgttattaatatgtcatggtcaaagagagatatcaaaggcttgctctttaaagaaaattcacagcatatcttcttatttacaagtcttaaaagcctagattttctgtaatcccagcactttgggaggccgaggtgggtggatcacctgagatcaggagttcaagaccagcctggccaatatggtgaaaccccatctctacgaaaaatacaaaaattagccgggtgtggtggcaggtgcctataatcccagctacttgggaggctgaggcaggagaatggcttgaacccaggaggtggaggttgcattgagccaagatcgcgccattgcactccagcctgaatgagaagagatagactccctctcaaaaaaaaaaaaaaaaaaaaaaaaaaaaaggcctagattttcaaaaggtgttgctttgtgtgagtctactttcaggaggatgaggtttcaagaagacatttcaaaactgctttttttgtttgtttgttttaaaatttatt

SEQ ID NO: 136654 - DNA, 1042 bp, Homo sapiens
gactataggtgtgtgccaccacacctggctaatttttgtatttttttagtagagatggtgtttcaccatgttggccaggttggtctcaaattcctgacctcaagtgattcgcccaccttggcgtcccaaagtgctgggattacaggcgtgaaccatcacacccggccttccctgtttaattcttcttagcatctccactaaacacaaaccaagaaaggtgatttttctctttgttagaacttcttaggaaaacttcactattctcttattccatctgttttggggttgaggagagctgttatataagaagttattgttagggtttcttgtattcctgttgtaatattctcaagctgacatatttgtgatagatcaacaaagcagtaggtattttgtaccgctacctaagcaataaaagcaagtatgtaatgctgtagtaccagagttgtggtttttcccctgcacaatatattaactaagcagaaaatttaaaagaacaaagacaataaaagtaatgtttgttagtggtagtttgagatatttcaggagagatgagatgtgaagaaaagcaatggccatatttagaaagctgcctcaaacccaagagtatctattgaagtaaacttgatgacagacttttttcctcttcatgaatcattgtattcctataaaagcgaaaattcctcttcatctaaacaaatggcttcaacatctgttttcttagtttctcaaaagggtgtcttcggcttgcatttttttttttaaaagtgtttatctgtttaaaatgaaatatcgtcaaaagcagtttgtacatcaaaatccaagttggtcttcagcttgtaagaattagttgagaattatctggtggtgttgatagtggtataggggaaaaaagaaattacattttgtattctgcataggtaagttcttcttcctaaccatattctttaaatttttttgacttacatttaattttacatgctcttagctttggaggaccgattgactaggaaacttgatcgttgagagcgcattccaacgt

SEQ ID NO: 136655 - DNA, 2160 bp, Homo sapiens
ccagtggaatttctgggccatgatagaggtgtttgtctttccgaaaaggttgcataggctcctcccacccccatccaccccacagctgtctgttgtgtctgaacagtggcttgctctgaggttaaaggtccatgaaaactgtgagacatttgatgttataaaatctaattagtgacaaaagcaattaatataatcacttatgacttagtttctctggaagggtatacttatctttattgaataagtataaatggtaactgctagcaaatggcaccaaacttaacataaaatagaactacccccacctctctcctcctctccagtgcagaagagaggcagtgaaaagggtggttatggttatgtaggtgtagagggctctaggaggctcttgtgacttgattggtgttcagtctccctgttgagcccatcaacatggcctcaaggaggggagctattgcaaaggttttgcctgctgtttgttaagccacagcttgtagttttggttgcacatgacaaagcaaggtgctctccttttttgaccttgttcagaggcttaatacaattatttgtattaagcactagccacctgttaggatcattctcattaaaggtcactgtgtggtgcctgactgtctgactatggcagcctgcatcagatttgctagtggcccctggtttgtgtgacacctgccaatagtaacagaaagaatggagatctgatagctcaaagggaacagaaggtactagaggaggaatgaggaatcaggagaaccatggagcacctgccactctagcaccattaccatggtttttggtgctaacttgcctagtctcccttttctctggctaccccttcagtgagctgtgccaggcatttcgaagagttctgttattgtctgcatgctgatattgctttggtttattgatattaatatattgcatccctgttaagcgttgaatttcttgtacctgaaattccttacatcccctctgctgaatgtcttagcttctgtctgcttctctgtgatctccattgaggtgttccacaggcatatcctattcagttccaaaactgcccttgcagttctggttgccagcctgtttcccttccctgattcccggtctcagtgaatgatgacactgtttacccagttgttaagccaggaacatgggtatcattcttgactcctatctcttcctaatgcctcaaatccagcccagtgccaagtcttgtagattgcacttgctaaatgtctgtgattctctgtctccagtgtcactgcaattatgctgttcaggcctcattacatctccctggacactgcccccctcaagtattctccagatgttttatagccagagagaactctttaaactgccaatctgcttatgccactccccagtttaaagtccttaatgtgacttacaaggcccttcacatttgggcctctctcccaccctctctccatttcccctgaacattctagcctcaaccatacattttattttctttgcctttgtaaaaaaaaaaaatttgtttttttaaaacttaattttttttttactcaccattcagcatttccctgtgttctttgcatcttcacaaacactgttcttccatcctccttttcctgttattccctatactcaccttccccttatacattatctgtttttatggacttttctctaactcctgccccaggagcccctgttatgtacatgtgtgtgtatgtagtatgtgtgtattttccaattgcctatttggttctctgctctactgggggttatgccctataagagggaagggatcatgtctgaatcattcacagttgtgttccctatgacctacgtctagcacatgagaagagtttagtaaatactgttggtgtttgaatgaatgagttccttcttgaggttctaaatgacaagagaatatagtgcttcctataattcatatcaaattcttgagccttggccaaattagagagtggaaatgcacaggctgggtgcagtgacttacacctgtaatcccagcactttggggggctgaggtgggaggattgcttgagtccaggagtttgagaccagggtaggcaacatagtgagaccctgtctttaaaaaaaaaaaaaaaattagccaggcttggtggggtgcgc

SEQ ID NO: 136656 - DNA, 1717 bp, Homo sapiens
ctgagttaaagggtgagggaaggcggggtgggggagaaagttacatgtaaatcatttagccattaacctaatgggtgggtttataaatcctattactataagcccttttcatttccactgaggcctggtgcatgcttgatcccactaatgtaaaattcattccgtctaagtgattactgaagtaagacactttgagtcaattttaatcaggttgtgtgaaacttgcttgagtgctgatattcactaaagcatggacatagtttggccgtgtcttaattagcccccctggatgagttatatgaggagtcagtcaggaagccaaatctctgagccttttcacatatacatgtttctgtgagcaaaataaactgtaggtaggggctgaaaacacccacctcaaaagcaaggggcaaggacctttgggtgagtgtgtttctagtcttaatgaaaattgtgaatgttaagaaatctgaaagttctattcttacggtgaattggagcatcctcaatggtacttatatttaaacaaatcagaatttcaagtttgattaaatatgtggatcttctttctagaaaaatgcacgtaagcacacattcaaatctttgctgacagtttcaggggattttcagatttcttgaccttaggttaatacctactgctccagttttaattttagtatcttaggtttttgttttttttttaactggggatgtaatatttaggattgtataggctcatattgagctcttgtgtcagtgagtagatttggttcaagtgtgctttaaggccagctctacaagctgtccactgtcctgtgtcagatataacccgaagaatggcagcaatacttgtaaattcaagtgaaacatataggacatgaacttctaaactggaggttggagtggaagaggaatggagaataagaatgttgtgaaaggaaggtttctttaaaggtgaaaactgagttcttaaaagtcagcatgtgaagtgggtttttaagaatccacaggatgaataaatagtcatgctggggacaagaaattataagacacgttataagacagggaagaaattcacttttcctttcacacattcaaaggcatagtttgtagtattttaagttttgggatcaaaataatagccctgtcaaactgtagggcaataatggagagatactcataaatcgtattaaatttgtctttttgggaggagaagcctttcagaaattgttgtttattcagtgttttatattcttcatacatgagctaccagaaggtctaggttgtaaattaaggatttaaaacaaaatcagtttatctggaaactatagttgtatgggagaggtacacttatagtcaagtttataattaatgggcctttgtcattggaatagaaattcttttctcttgagtgaatatttgtttatataacatgcattgtgtttgaaggtgggatcaaaactgattcactcttcatttcttgcatggaaaaagccagcatttaaatgtgtactgtgtgtgggcttaattgctgctttttgtaaccaactttagggtcctgttgttgtggagatgcacttactgatcgataatggtttgctcttcttaagctggaccactaggagttttcctccttttactagagcctaaaaaataaatatttattgaattattactttgtgccaggcatttcgttaggtttaatgcccatgatatg

SEQ ID NO: 136657 - DNA, 1118 bp, Homo sapiens
aggccggcagcccagggaatagttgatgtttcagctacagttcgaaagcagtctgcagcagaattcgttctcccttgagagacctcagtcttttccttttagggccatcaactgatttgatggggcccgctcacactgtggtggatatactgctgtactcaaagtcaactgatttaaatgttaatctcattttaaaaaaatacctttacagtgacatctagactggtgtttgaccaaatatctgggtaccgtgacttagccaagttgacacataaaattaaccatcacacagcctaacttctcaactcacatttttaaccacttggggaaagagcatgtaaaaacacagaagcaagaagaaaagcatagcctgtttaatgaacctaaaatattttgagagggctggtttgaaggtgcatgtaggaagtgttagaagatgagataggcctcaactagatgagtctcaaggacaggctcaggggtttgaattttatttcaagaagtacattttattatagaaagaacactggcaaagtgtgaagattggcttgggaggtagtgatgctagagacaagtaggccaagagagtgatgggtgtctgaaggaaggacatgggaatgcagaaaaggtgccacattggaaagatgcagtatagttagtgtagcatatgtgggctcattggattagaaaggaaaccatttggggccaggcgtggtggctcatgcctgtaatcccagcactttgggaagccgaggaaggtggctcacctgaggtcgggagttccaggccaacctggccaacatggtgaaaccccgtctctattaaaaatacaaaaattagctgggcgtggtggcgcctgcctgtaataccagctactcgggaggctgaggcaggagaattgcttgaacctggaaggtagagtttgcagtgagccgagatcgtgccactgcactcccagcctgggcgacagagcaagactccatctcaaaaaaaaataacaataataaaataaaagatagaaaggaaaccagtccttggttctggttgaaggtttctggaggggccagttatcatgtttggagctggttaagggtttggaggagatgggtgggatttag

SEQ ID NO: 136658 - DNA, 2896 bp, Homo sapiens
gttggattctagatttttagacctgtgaggaatctcaacctcttcattttataaatgaggatattgagacctagaaaaggaaaccaacttggtcccaaatcacttagctggtaattggcagattaaacaagtgctctgatttcagaccctagacttaaaaaaaaaaaaaaaaaaaaaaaaaaaaaaagcacgaatatttgtataacattttatctttgcaaagcactttttaagcctgtggttctttttattcttacctagctcagggaacaaggtggtaatatcaccccaatattagagaaaataaaactaaggtttaaaggcagtaagtagcccagtatcacagaagtgttaagtagtgaagacagaaagtaccatgcttattaaatccatagcccatatttcttgaacatttttagaggaagacacaaatctaagaataacagagaataggaaaaagacaatctaatagaataaggaggaaataaatgttcatcaagtgagagaactgagtagcactgagtcctgcttggcagttgctgaaatttggaatgtggaatgcttaggtaatggttggattatcaaatatcataatatttatattaatatttcacctgcctttctctttcctagccttcaaaaccatttatattttactacccctgttatgctaatgtattgtttaatttccagtttatttctaattttatatcatcggtaatggaagaatcctaaagccattgagatttcagttgtcattctctttttgcattatttgtttagaatttcaccttactcaacattttcttaacttgtaggattttctttgtgtttaatatctgcatcatacaccaaagtgggtttcttgttaataagtaatactatagtagacatgttttcggaataggaccttgaaactttttttttaagctgtggaaagctggtgttttctctctattgtttagtattaataaatactcttttagtctgtaatagcatctaaaaacatttcataacctttggatgcattgtgatacaacagtattctattttaacaagatacaaagactcaggtgttatcctgaacttattaggagaacctacaaatacacatcttagtagtagttggtcttaggttgttgctgttgttaaccttggcacacacaaaaaacatctttctgcttagtaaaccatatcgtgggtatattcatgaacacattattttctttagaaaacaatttttgatacacatctaaatttcctttctagttcccactacccttttccagctttcagaagctcagactggggttaaaattccttttcgtattattttaattattgctctccccacctccacccctttcctgtttccccctcctcttttcccctaacggcactgttctgcaaagcctgcaatgattgatatgatggcagtgctgtcattctttttaaccaaaaaaaagtcatttttgttctagttattttaatagagtcccattaaagatgtattgctgactgaaatatcggcgtgaagggctctcactgagctgagcccaggaattaagaagtcaggaaatcggctgctgcattgcaagagagccttgtgtgacaccgagtctcctgattggggagatcattactgctattatgactcgacttgcgtaggaattttaaattccatctgaatgtcagtaataaccctcttagcaaattatcctgaataaaatcacgaaggcattttatataataggtgttgaattactggatagatttgctaattaaatactctttgttctgctgcagttgacattacagggtaagatcttgaacaattattctcaacagctgtactttgttaagggaaaaattaaccacaaagtttatttttttatacttgaagttggcagatttttgaaatgtgcttgaaaaaattccatcatccaattggtaatgagtagataaatatgcaggtgttgctgtgaaatcagataactgcagactgccttattaatgaatttagcaagcctttatagccctgttttctagccgttagcacttacaaaatgattttctgtcagaatgggcagctttaatattacacttgtcacttcaaagtgaacttatgaatggtcatcttgtaatcattgtaccttgtgtctagtagacctttctgggtacttgtggctatttttaaaatgtgtttcttcaatggggaaaatacctgtaatgtataagtgtttgattgttgacttctagaacatttatgtggtatgaggttttttttttttttttttttttttttttttttttttttttttttttttttttttttgagaaggtagtgagacataatgaaaagaaagtgaaacataaagtccagcttctggatcaagcttttgggcaaaatctcagagcctaattttcctcatttgtcagttgggatttataatactgtgtaccccttaggattattcacttagcattctataaatatttattaacagctcccatgtaccaggccctctggtagatagtaagaatttggtagctccctgagtagataacatctgagccctccccagtgagcagtttgaattgagggctggacttgagggcagctttggagtgtttctgctcattagcacttggataagcattggactagagaggtcactgtgatacccaccatctagaactgcttagtgaagaaacatgagaggttaggggtcagactggttgtgggttgtcttgtatagaatgggctgaagagttgacaaactgtggtgaggaccttgaacctgagatggaacattatcatcagctgctagtgaggcccactgaaaagatggtgaggtccacagaaatcggtacaacctctatagagagctattgg

SEQ ID NO: 136659 - DNA, 3055 bp, Homo sapiens
tctatagtttaccatttctgcaaaaaaagacatccaccaaaagatttctgccaccaaagagaaaattgttttggtagcagtcctcaggttatgcatggcaatggttgtgagttggtggcaggatggagtaggggtggatgatggatctgaaaggtgaaggttgccagttcacattgaaggtacactcagggatgacatagtagatttggttcatgttgtgaaacaagagtagaagaaattggttattgaatatgtggagttgtagtaaaaggttgacaaactgctcctcaggtattttattgaggtaacagttacgttatggtgttgtccattgtgatgaagaaagctaagcctagctaactgtaagaggcagagggtaaagaggactcttgataagtaattctgtcctcactgtgattaatttgccttgggttggtctcattattgccctttccctaaaggaattgtcaaatattctcccacaatgcatttccctataatttaaatgttaaaaaatgaagatgaagttggggagagtgactgttttttatgttagctgaattttagtgtctagtggaaaagtaattgggattactacaggacctatcagtcacctggcaaacagttttttgagttcctattacagtgaagtctgcacttaggcacaaacatgtggtctgacctccaggagcttgtagtctagtttggggtgggtaggtgggagctaataacgtaaagcatcattcaagtactagtaaaataattcaaacacagatgagaggagagagacaggtatgggctgggccagtcagctcatgcaggaaggatttgagccgagggttgtaaaattcaatgataggaaaaggactggggaaggaattccgggtaggagacacactgcatgagtgaaggcatgaaaagatgagtctgtacacagttaactgttggaagactgggagatttattctgtccagcaagaggatctatgtaaaagaataacaggccatacaagtggaacagtggtttaggtgcagttgcagaatttgttcttgaccttgtaggcatcggagaggcattgaaaacattcaggagattggtaatgatattcagggtgagttgatgagacctaaagccagtagagacgcgagttggttcatcctcagtgacaacctcattgctatggagtcaggcgctttccaccttgcagccggccctgctcagcatgttagcttgcaccctaggcatggcccttcatggccaccgtgatggttgccactgctccaagcagccctcagtctaaaaaggtagtcccccaccgcctgccccctcaaatcaggaaggaaaacctttcagagaagcatcctacaggaattctccttacgtttaattggccaggattctgttcacatgctcacgcctaaactgatcatagtttccagaatggaattgccatgattatcttaggccaatggtccttaagccagcttgcaatgtaagaaaatgtaagaaaactgttggggccagatattgtttgtttttttttttttaagatccccaggtgattccactgtacagtcagtattaaaaccactggcttagcctcatcagaattcaccaccattcaccaccccccaggtaggagaaagggcttccttgtctaagaacataatattaatacaacgaacatctgaacaaaactgggagatagtaataaaggggagagggcaataaaaaatggaaagtaatgggtagatataaaagatactctaaagacaggatttacaaagctctgtaatagggaagacgagaaagaaatgacaccatgaagcttgagcttagttgacaaggaggactattgaagtaggagaaagaaatataaatgaagtaaatctttatttggtctattggaaaggtgacctcagctttaggctgatgctttgaaagatgggtgatagcagagaggcaatagcatggagtgactaagaccccatactcgagtcagaatgcttgggttcatatccttgttttgtcattctaggacactaatttctctttgtcttttggcatctaacaagagaggatattaatagtagctaccccttggagatctaggggaatgaaatgagaaaatgcacaaggtgttccttgcacagcatctagcacatgtattttaaacgccccccccgacacacacactttctctctgagtcctaattatgtcatattactattttttaagaggctgtttgttaaatatgtgttacttctgatctggctcaaaataatttatatcagtttttatttctatccacgttgtaacctaaatatctctgatctgtagctatatgggcctggggacagacttatcaacagatatccacgttcgtcttaattcactgaatgtttcttgagccccacctttttactgggtactggggtagctccaggcaatatagtgaaaatccatctactctctttcttcaatgaatttagtctagagaagaattttaaatgtagtgtgcttttttttgctttttaagatcctgaataccatgaataagaattgccagatttgaaatgctttgttaagctttttttaggcatgcagttctatttaagtattagtaatgagaatagtttgcttttttgccatgttatagagatattttattgtgtgtgtgttaaacatatatatgtatatatatgcatgcatatctctggctcagaatcagcatagaggcaaacttagattatattgatgttactgttattttaagggctgttgttagaaaaccttcaagagctttagaaatacatggaaatggcaaatcattgaaagttacctatctctatgtgcttctatttatgtctttataattgtgtaacttattaatcttgacttttgtttcatttagattttgatgcatacgaaagagatggtacaaaaggtaatgttgagcattttcattgtgtaaaacttaaatatcataactggtaacgtttttgtattcaaggaaaattgtaacccaaacagactggaaattgcttcttaggt

SEQ ID NO: 136660 - DNA, 1009 bp, Homo sapiens
gtactctgtgctaatgtaatgcttgtcatttttgcacatttctgtactgttgaaaacatttttatattgcagcaattacagtgttatttagaaatatattttcatttaacataaacattttcccacatttttatattaccttaaaaatcaaattaatcagtgtattaaaaagatgtatctgtttcactgatacatctttatttaaatttgttgattatttaatgttttctattataaataactctattgaacatctttgtttatttatctttttgcatttggatgaattactttcttattttaggttccttgaaggaaaatatttgagtcaaaagatgtgaatatctgtatggcttttgccaaattgctttgtaaaaggatgataccaattgataatagcaaaatatgccagtttcaccacagttttgcatgtagtggtgatgatatttaaataaaactttgctaccataatgaatatgaaactgtatttcacagttgcattgaatttgcatttctttgattcctagaagggatgaatattttcttacagtttatgtttattcttaggtaagttgtttcctgtaccttgactatggcatccttaatgtcatgaaagaagacatttgtttatacattagaaggggacaatgtttcttgtcactggctctccactttaagtgatgaagtgtacacatattggcatggaatcactgtgtcatctagaaagtagattccttttagattttgttttctttctcaaaaatttatatgagtaagagttacgacttaagacttcttttggtcagtttttgcatcaattctgcatattgtatccctgatcctgtctaccttcctagaaacttgggtttctatcacaagggcttccagggatgagtttgggagtgtcagtcctagcatgactgcataattggcaaaataacactgaacacatctcctttagggtagtgggcccacactgtaaccccctcatatgaatgatgacacaata

SEQ ID NO: 136661 - DNA, 1084 bp, Homo sapiens
ggcgcggtggcttgtgcctgtaatcccagcactttgggaggctgaggcgggtggatcacgaggtcaggagttcaagaccagcctgaccaacatggtgaaaccctgtgtctactaaaaaataaaaaattagctgggtgaggtggtaggcgcctgtaatcccagctactcaagaggccgaggcaggagaatcgcttgaacccaggaaacggagattgcagtgagctgagatggcgccaccgcactccagcatgggcgacagagcaagattccatctcaaaaaaaaaaaaaaaaaaagaaaagaaaaatgtatttactgtcccattattcttaactttcatttaatagagaagaatttctgcagtgttgatgcaagtacagtaaattctgatgaaagggctatctttattgtagttctgtatctatttacagtaagctattcatttgttaaaggtgatatatcctgaacatctttaacatttgtctaaatgcttgcactatttaaaacttgtgagctattcagtttctacattttactgcttcgaaaggagagtggaatggaagagtctatgtatgtgactggttgtggatggtctcatgacaatatttttttttttttttttttttttaggtgatgctggtagggcttgaaaatgacaggttaaattagggtggagacatgcatgaagtgatgggatttacctttagagattttagcccgtgttgccaaaagcaactgaaaaacagcatgtgtgattttgctgaactactgcaatcttagcttaaatatatttcacaaagtaacacaaaatactttgcagctgatttttatagctctggctaacttgagcctaaaccaccaggaagcatttttttttttttaaatgaagccttctaaaactagcttgtaaagtccccaaatagcctacatctaataattggaaagtatgtcagctgaaatttagaatttcttaacattgcactgaagaataatccattgaagaagataatggatttcttaagtactgttatatcagttaagatttttatattgtattgcttgtccaagacaatcaaaacttcacgt

SEQ ID NO: 136662 - DNA, 1041 bp, Homo sapiens
tccccaggattaccctgataaaaaaagcctacctcatgtacatgttgccctctggataaattctcaaggaggcagaaaggtgaaagctggagatactgtgtcatatgtcatctgtcaggtaaactattgacattcgtaagactctgacacctcttaagaactgaaagtaaaatccaaattaccacagtgtcttatttagcattctccccaataattgatgttgtaaagtctggttagtttcatagcatttaaaaaacattagaggtgtggcatatgtcattaggattttcataaaacatttatgacagatttgtaacagtagctactcttttaaccctaaattaactttaatgcaaatgtaagtttcgccatatgttcagcagtagtcctcatttatctctttccttttgcagcagttcccattataaatatcagtggaataataaaagaataaatgccattttttccctagcaaatgtccaaataattatgtgaaaaaatatgaactacatgattatacggagaagttgagagatcctatgaacataccctatgaggaaaccacacaattcaaccagtttttttttttttcttccttcaagtggagagggcccacctccttacccttccttctccgtttcacaaggtacctctaggccttctggaacacagttttaagccactaccagttcttttgataatagcatgcctataatgggtgaggagagagagtaagagagaagagcagttttttgactttcgaagcccttaactattttaacaaaggagaggtctcatcccttctatctgtaaagataagtcagggtcatagcatttatccaaattctttcaaattacaatggtatagactacttaccataaggtataatttatctgaataaaacttttttaaagaaattaagttttatcctaattgttattgcattgtgttgttacagtaaaaaaatgttttacataaacctaaaaagtaattgcaatatgattgatatttgtcaaaccacaatcaatgtgtttttaaat

SEQ ID NO: 136663 - DNA, 2069 bp, Homo sapiens
acatatcccaagaaaacctataggactttaatttgcctttgtaccctacccatgggacatgctccctttcaacctgtttgctagccaaatctgcctaaattttttgcttttaagcactcaaattattctgtttcataatgcagccatatttttagaatatgcttttgaaaatgtatcatgacacttttttttttttttttgagatggagtctcgctctgttgcccaggctggagtgccgtggcaccatctcagctcactgcaacctccacctcctgggttcaagcgattctcctgcctcagccttctgagtagctgggattacaggcacgcgccaccatgcccagctaatttttttgtatttttagtagaaatgggatttcaccatgttgaccaatctggtctcaaactcctgacctcacgtgatcctcctgcctcagtctcccaaagtgctgggattacaggcgtgagccactgctcctggcccatcatgacacatttttaagaggactgtttgctgccttaagcaagggtgtcctccaagaatagcctatatcctaaacaggttttgttttgttttgtttaaaatttacgtttaggaaatagtaccctactgataacttattcagatgggttcagagagtaatgtttttggtatgtaatttatattgtaggttgttagcgcattaaacctatgtgaattatttgctcagatcttaaatcaacttccatttgttggctaggttttaaatccataactatttaactttcattagacataatttccataaggcatgcctttaacataattattttaaggggcccacttgtctccagtttaaaatattttcccattagtttcctactaacgatgactacctagttttgtatgaatcgactgcacctggttgtctctctgaagtatgtactttgtgaagttcacaaattactacatgggcacttgaagaagaccagcgttgcttcttaatctgttcttaaagatgtatgccacgtattcttgcacataccatggggccctgctcaggtttgagaatgaaatctttgaaggttattattatttttttttaattttgagacagggtctcgctctgtcactcaggcaagagtgcagtggcatgaccacagctaactgcagcctttatctcccaggctcaaatgatcctcccactttagcctcctgagtagctgggaccacagatgcatgcctccatgcctggctaacttttttttttttttttttttggtcaaaaaaaaaaatgggggtctcactgtgtcacccaagctggtgttgaactcctgggctcaagtgatccttctggctcagcctctccaagtactgggattacaggcatgagccactgtgtccagccgaaggatgtatcttaggtcatagcctaaatgtttttccaatacgacatagcaaaacctgtcatctaaccaagtcttttgaatttagccatgttcgagcttagatttttaaaataccctaagaaatatgtttgtgtcactttttgttaaaactagtcttttgtgtgaatatttagaataaaaacgttttaaactgaaagcatgctcagaaagttttcaactgcttttttgaaaaccatgctttactatgagaactactgaaatattagaaagtaactctaatatttttaaaggcaggtgcctttaaaaaatattttacatgtataaattctattttaattcaccattaaaaattgttaaactcaacattgctgtaatcttaagggtagaccaatttttcataattccgtaaattgttcagattttatgtgtttggtaaaaggcagtctaaatacaattgagttgtgtgaaaagacactgccggaggattttttcacgtggtttttatcattggttgtcaccttattatcatcttaacaattcaagcttctgaaagagcaagaattaaacttgattaattatgcctaattccttttactatgttgtaaactcctgacaaataataataagtcttttaatctgagtttgcttcctttttaggtatttcattttgtcttagaac

SEQ ID NO: 136664 - DNA, 1050 bp, Homo sapiens
tggcataatttcatttaggaaaattattaagctcatgattttttatttttaagactcttttgtggagagcaagtatatttttcaactacttttttctttctctattgcttttatactactttccttgaaatgaaaggcaagcatcaagtgttggtttatcctatggcttcactttggaaattctctatttctccccatcaagatacctcctgaagtctgtctggtggcatgttgcatggccaggtgttccgtatggggagaccattttagtgaaagggagagaggatagcctattaaatgagtgaatgaataaggctcttgaattgaaagagaataatttgttctaataactaatggtcctcattatcccacagtaaaatatgtatcatttttctgaaacccatgcaagattattgctattgggcttaaataaagcaaaattttactcttttccatctgtgaataggaaaaaatatagtattactcttcttatacaatagccctatgggaaacatggccactaaaacttgaaactcttagcttttgttctctagactatagatttttctctctctcattctattgaaagctctcccgtattctgtggatgaaatattcacagtatgctcaaacatccaaatagtcttccatacctagctgactaggccagtgatgagaatagtctaaagttcatttttgaatttcatctttgaataaatttatgttttatgtataacggtacttagaattatatgtaatatctctcctccaatgagcaatgatttgtacagtagttataaagaacctttcttcggggtcagtgataaaatttcaggcatttggctatctgggcagttttctcattggtcctgagaaattattgaggtttgaagaacatgagaatttagaatttaatctctgaaaatactgcttaaaagaagacagaacacacttaacccagtgtgttctgagttaaattggaaagcaaaaatttccttttaaaaaaatgatgcataccactcatatcacagaggttagtttttgtcagta

SEQ ID NO: 136665 - DNA, 1020 bp, Homo sapiens
tccagcacagagttaccatcttttctcaggtttaaaaacaggaaaggaaggccaggtaccgtgcgtggctcacgcctgtaatcccaacactttgggaggcaggaggatggcttgagtctaggagttcaagaccagcctgggcaacatagcaagaccccatctctacaaaaaataccaaaattagctgggtatggtggtgcatgcctgtagtcccagctactcagctgactgaggtgggaggatcacttaagccagggaggtcgaggctgcagtgagctaggtcaaggctgcagtgagctgtgatcgttccattgcactccagcctgggtgacagagcaagaccctgtctcagaaagaaaaaaaaaaaaaaaaaaaggaagaagacacttgaaaagcttcctgccaagaaatacacatctcgttaagttaaaatttatatttgtgtctattgtcaagggcattaaaaccagttgattgaagtcatgagaatgctgctcatcaggctttttattctgtcaagattttgagaattatcttctccaggaaaataaaaatcttgggtattcatttaaaccaaaggctcggctattatttcttctaaaatactcagaaattttccatttatattatgaagaggtgtattgttggtgtgaaagacagttttggttgtctgacacttatacagtaaattgtttatctttaaattggatctgtagtattttaaaaacttgttgggctgggcatggtggctcacgcctgtaatcctagcactatgggaggccaaggcgggtggattacttgagatcaggagttcgagacaagcctggccaacagaacagggtgaaaccccatttctactaaaaatacaaaagaattagccaggcgtggtggcgggcacctgtaattcagctgctcaggaggctgaggcaggagaatctcttgaacctgggaggcgaggttgcagtgagccgagattgcgccagtgtcctccagcctgggcaacagagcgagactccgcct

SEQ ID NO: 136666 - DNA, 1067 bp, Homo sapiens
ggaatttttcactcgtggtatcatgttggcactcaaaacgtttcaaattttggaggatttcagatttttggattagggatgttcaacctacacaaacatcttttcctatttggcatgctttttaagagtataattcacataatttaccataaaatgctaaaatcttgagtattatacaatcagttatctaggcacagacacagaacattttcatcactccagaatgttccctcgtgcctcttcccagtcagcacctctgttatagtagcaatcgctcatctgaaatctatcagtataagttagttttgcctattcaagattttcgtataaatggtttcctacagtatatactctttttgtgtgcaacttctttcacttagcatggtatttttgagattcatctgtcttgttgcatgtagcagtattcactctttcattgctgagtagtattagctgagtagtattatggtagattataccagttaatccattcacttgttgatggacatctagagtgtttccatttttggctattatgaataaagctgctatgagcattctgtggatatagcattcaccatttgaaaattatttttttctttaatcatactaaattttcagttcgcatattgtcctctaagatgtccagatatatgaaagcctggactcatgcaaaagataaatggtttacttcctctaagaaatttttacaaaaaaatttcactcaatgggattctgttaattagcttccctcatagattaaatgatccatattacaaacaactgcttgtaaataccagttactccctttactcatttggaatttcatttatgtggattttccctcttccccacttgcatgaacatatgtaagggttttactgtagttatttgctgttgcactaatagagaccttgtcttttgaaggaaggaaagtatttgattaaatgtatcagcctctctaataacaatatgtctcaagttatgaacagtttaaaaactccttgggagtgggggcaggtgaacattctaaaaacaggcataatttacaatggttagaaagtgca

SEQ ID NO: 136667 - DNA, 1158 bp, Homo sapiens
caacaattaaaaatggaattatatgtagctgctgttttgcacattttaaaattcagaatctctacctgtaggtggcagcaccagatacttgtttcttgtttcactccagacttaatgagtttagggtataagcagtaaaactttaaagtctactgaaacttcgaaataagctgctgttaccagttttgtgagaatttggaaaaactaatgtatgtgttgactaagtttggggcttatttaaccctggattttcaccttttcaaaaaagattccagcagcaatgatccttacttttttaacatgacattgtatgttttcttaaaatgatttaatttagccctctgtggtttgcctgttgaacttataactgctctcccaagaaaataactttttaatggcattttggtatttaagtaacttgtacaaggatcattatatacctaatattttaagctcattacagtctcttctccctttatatttttacattttagcattgaactatgaccaagagactattgagattgaagctccttcccctggggaaaaaaaaaatcaccttgggaataaatctgaagtaattagctgagccagttgactttgttactgccatgggaagattgagtgatttgtagaaatggatatttagggtagacatttagagtagacatttcacagggcctggtatttttcgcaagttgcagccagtcgtttgggtgtttctccatgagtaagtaacaagatggcccacacccacttttagcttactctgcaggcaggctgtcccgggtcagtgcttgcaggttcatgcactcaggtgcaccaagtgagccatggctggtggggaggggtagagagtagctcctcttggttccttttcgtagcctggccaattttgtatatgtgcaaaccagcattgttttgttcctttatttttggactgtgaaagaaacttgccttttagaaaaatcttgcttattttctttttccttatcttttgattagtgttggcctgggaaattgattaatagtcatagggtcagagaaaaagtgaagctgctttctcataattgcaaataaatcaaaacattatgtgaatacttggattcacaactagagtttgaattagcgacagttacccctcactacagagatgaa

SEQ ID NO: 136668 - DNA, 1929 bp, Homo sapiens
gatgctacctccgtttcgcaggtgagaaaagtgagactctgtgtctcagttgtcttattctttgtttggcccctttcaactgtgaagagtcagcctccagtattttataattactagatgtcgcttgacagctgaccaaataggatttaggattctgtcactgaattctgaatgcatctgttagatttatctacctatgtagctgttgataaattttaaacaatttttagatatttttggtatttgtgagcttttggcttagtgactgttttatattacttatttacctttatactaaaataagatagttttctcttagatttccaaaagcttttccttagatttccaaaagatagaaatattgtctcttataatcttttcttgaaagcatcccttagcaatccctaaaattctaagaaacagtgtagaataattatttttaagtataaattcaaatagtaaattttggcacacatgttttgaccaagggtaaattaaattggttggcctaaaaatgtttcttttctttaattagtttgtggaaacaaaatagcataaacatgcattgattgatttcttatgttgttttgaatgaaatatggaaggtatatttggtttcaggattctcagggacattttggcctgtagaatctgtagacccattgtttttgcacatattttaaatttctgaatttcgaacatcaagaaaaccatgttgcattttgtctcagatgctgctactgaattttaaccactgaattagattgcaacctacatgctgttaactactgagccaagatgaaatcgactactgcattgaaatcagggttagctgtgtctgcacttgaaggagttgtaatggcagtgaacctgttttctttaatgggatttttattccctgattttattctcagttttaattgtgactttgattttaagagaatttcttagtacacatttatttgaggttttcattgtaactttaagagaataataaaaaacatcctatcgaagtaggtgcttccaaacccatatgttcagtggcatatttctgtgttgtgttgttgcagttacttgttttatttataaagtatctcttgtaaaaagagaagtcatttgtccatgtgcttttgagttcaaatggttgtgtgtatgtgcatgaatttaaaataattttttgtgggagttttcttctttggggtatttttggaatacttttctgaatttgtttttttcttttacattaataggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcggttagttgtttctgtctttcattttgtgagtgaacttgtataaaggccttacccccttcccccactatggggtatataaaaagggcgaaataaacacacacatgttgctttcatgtgtttaaagaattttagcatcatgtgaaatctaccttcacagcttgcttttatttctgtttgaaaactcttacttgaatgtgcttgaatattgttttggcttcctagagtgcttgaccttggtttttaagtggaatcccttaaaaattctaaattatcttaaagtatttttattataatttcttaattagtaacctgtattgtcccactgtcaacccccatctattaagacttagaccaatatttttccttatcttaaatcaagttactgggaactaagtgttttgggaaagtttgtgtttgtctttacacatcccacttacctccattttgcaaaggtactcttatcttttctgctgtctttgcatattagacatttaaaaagt

SEQ ID NO: 136669 - DNA, 1117 bp, Homo sapiens
agacagtaagtgatactgtttttgtggtactacacttttaacttttagactttatttttaaaattaacttgacaagatgaaaacaaactaatgtgataaaggctcttgtttttcttcaagtttgtaatgaataaatacaaatttaaagtttttaatcagtatctctgagaaagaggtttatttccagtaacatgacttcactggtatttacagagggaaaattattttatccatagagtccctcgtatagtgaatgtaaaatagtgatttcagggttttccctttgactttgcactccattatgatgatggcaaggaatggaaggtatgtatgactaaagcggtctttgggaggaaaataattgagaagatagggttaacaactcaccaataaaacgaattaagaatattcaacactaggacagcatgtaagtttttaagcacaaaaacccttttatagcctcacagtaattttttgtatacttctcctgacttatgtagggaacagatatggagcccagcttgtatcgttgcagtaacatcgattgtaaggcttcacctctgacctttacagtacaactgagcaacaaattgatcatggacattagacgtttcattaaaaagtactatgatgtaagtatccataatgatattcttacatacacaacttattgaggtttggtacttgtttattggttttcatgaaactaaaattttgaaaagacttttgggaaaaattcctagtgaaatactattaatacaaatatgataaagtatgtaattttggcatattagcatgacaaattatttgataatttctctcaggcattacatctctttcatttacgagcagtattttaaataatgaaatttttacttcttttagaaaaagccagaatataattaagaaatgttttagtttattgttacctaaataagactaattaaatgattgcttagatctttggataaaggaagaaaaaaatcactattggctattgtcagcaagtagagccataagatcgtgtgtagtgatcttagtggactgcccacacaaaactaatactttgtgtttatgtagcactctaaacgactccataccctagttttttgaggaa

SEQ ID NO: 136670 - DNA, 3504 bp, Homo sapiens
acttaaaaaatactacccactggacataaaagttgtttgtgaaatgaaggcaagaatctcaatattgttttgattttagtcttagaagcactgcaggagaagtcaacctgcactgagaaaggaaggtatcttcatgagaaagggactccaggaagatgaatggaatatggtacttgaccaaacactataacctgcgaagaagcatagttctagatgactaagaaattagattgtcaagaaaaaagggacaaaagtttggggtaacaaagtatacttctaaatcactttaattttggaaaagtacatcacattctgttaccttctgtcatgaattaacaggactgactaaatatgatataacaaatatttgtttaagtttatctgagaagcaaactgtatcacatcataatattttaataaatattggctcctttatgggagaggagaggctttttgctcctcatctgtagcaatgattgtattccctgaattctagtttcctataacatttaaactttgatatacatagaaatacagaaagcactgagccaggatattttaagtaatatattaatttctttaggaagaagataactctgtgctttgtcttgagatttgatgaagtgttgaaagacttcgaggtagcacagaaagccttatttctaagttgatttcatgccctggtccttgttggttcctttgtataaagttaaaattgaactggtattttttgaaaatcataaaaaggcagcttaaagacaataactctaagcttttagggttgtttttgaaagattccgttttacagtgaaaaattgatatgtgttccccctccccttaaattctgctccagaagagcaaatagacatacacacacaaaagggagagaaacactagctaatctaaattgggaaatgaagagggctttttttaagcatgaaaatttcatcatcttgtcagctggcagaatgcctgctgtgtggattcacaaaggctaagaattacactttcatgaaattttcctcactaactgccctggttaatttgaaagataacccactgttctaattcattcctcaattgggcggtgcaggttttatctttgatctgacaaagcatttgtgttaatcgttttggccctccactagacactcttgggattgtgcttttacaataaatgtgtctgtgatagctctttagtctattatacttacaatagatccatagaactggtaattaattctccactgctttggaaatgggaagaataggtgtagctctgtcaagtgctgctgggaagtttgtttagctggttcatttttgaagtgttcccctcagccatccaagaagcagccacagaagagagtctgagattgagaagctggcctatcctgatgacttgctgataaatgggaaatgtgacccctcttggtacctgggaggaggatattgggtcatttacattcatctcaagtactgttctttttaaagtatattaaactctcattttaatacttaaagagccatttgcctctaacggtggagcctctagaagatgcaatcgtaatagtcaactcaaatacgttcctaaattttcactgatggcttatgcaggttttagagtattctgattgggtaaagtgtgttccccaccagccttctagtgtttctagccacttgtacattatatgagtactttactatgatttttaaacattgcgatattgctggccctagatggggctggccctccatctcaaagaacacatgaacagcttgttggtaccatgcatatgataacctctgatagttgctagggccagaaattggtggtctcactccatagaaagttgttgtaggctttataatctcaggattttcctgaattaagctttttgaggacaggggctgtgctttcttttctgttttatgtgtgatctctgccacagcccttgctctcagaagtacgtgtatcttgatgtttagtagccaaggaactgacaagtaaaggttatattttgctgttttttccttaaatttttttacattgctgtcagattggcggaagacttattagtggcctacaggattcttgggttaacacaaaattctacaatattttaaggtcatgaaagccatgacaaataaagctctttgttacttttctattttttacggcactgacaactctgcatttcagtatatgcctgtccccaactcaatagctttaatttgttttttccccaaaccaaataccaggcaaagaggcattaaccagaaatatcatcatgatgcacaatagcacctagcctaaatgtactttcattgtccagatagaagaatctatctctatataacgtggcaaagaaagtggatgcctagctttgttactctctttctgttctctccttgtatttttctcttttacttcttagtatattgtgtcataagccacattttaaaatctcttttggacccacatttatgaggaatttaaaaaataatgtgcagtgtatgtcgccttatgatgcaaaaacttccttatgcacacgtttaagcacttagggaagaagagagcatttgaccaatgatgctgagccttagcatggtagctgtgagttcttttggacgaggccacacaccaggaagtagagtaggatgttttgtagtgtatgaagattccatattaagcttgtttttcatctttgcaagttaaacaaaaaaactttaaaattttaaagtggatatgcattccttgaagacaaaattaataacaacccccaagcataatgttgttaagccagggattgaattagagctgccttttatcaaaagtgcaatgagggcagggtaaaatattggttaaaatatttgctccacaaaaatacccatttagcatcacaagtaagcacaattcatggctcccaacaatacttgaaaaagggtaattttgttaggaatgcacaaaactaaataaataaatctgataaattagagatgaagcagcctcccactctatccctcctgcccacacccatgtaaatcactaacagggcttctcatttccattgtctttcacttctcaacagagctatcttgtgcaggtggacctgtgagttttagagccatgcagtggcattcagtaactctactgtagtttcattgcaaatatgcagtgttcaataaccctcaaaatttctcatttcttacctgtggtgatgtggtttgatagtttttaggttataggttgcaatatgcagtagaatcacaggtatattagttcaaaaagtttaagcacttttggaattattgtttatttccttgcttctgcatttatatttagaacatttaaatagaataaatttggtttcttttttgtagactctaacagcataattataagtggtacaaaggcatacaaagaagcaatagatatccatcccacccattcaacatcacaggcagcccaatccatgctgcccagcagcgcttgaagaaggataa

SEQ ID NO: 136671 - DNA, 1026 bp, Homo sapiens
caagctctgcctcctgggttctcgccattctcctgcctcagcctcccgagtagctgggactacaggcacctgctaccaagcctggctaattttttgtatttttagtagagacggggtttcaccgtgttagccaggatggtctcaatctcctgacctcgtgattcgcctgcctcggcctcccaaagtgctgggattacagacgtgagccaccacacccggccagctaattttttattttaagttttgtatagacagggtctcactatgttgcccaggctggtcttgaacccctggcctccagcaatcctccctccttggcctcccaaagtgttgagattacaggcgtgagccaccatgcctggccttaaatgtggtattctaacaccagtgtccattcatggagggttggtatgtttttattcatgaatggctgatttttgttgttattgtcgttgttgtcaagcaagctcattttgagtcaggtataacattttgctgctatgccatggcatgttctcacagaaaaattaagaaacaagggactggtggtgattggaatagaatctcattgtaagtaatttatccttgtacaaatctaagtgaataacagatcaaatccaattccctaaaacatgccagctatgtattctatacaagcagcttatcatggtatatagtattaattgttgtaaaggagttctaataagcaaataagttcagatgcagccatttatgccacttgacttttatccttcgtagaataactaacatttacctgtattttctacatttatcagaagacccctttctcttttatttcatttaatcataatcttatgacatgaacccggtttggggaggctcagatctagagcatgattttgggggactaacatggaaccatcaccaaattctgaggtgctgaaactgcagagaatattgttgcctattgaggactaacccccagagccactgacgagatctgagcttgggccgtagtctctcccttacccatatcatttccca

SEQ ID NO: 136672 - DNA, 1049 bp, Homo sapiens
gggacctctgtatactcttaaagtactgaggaaaatgaagagttttagtttatgtggatattctttttttgtcactacaccaaatctggtaatgatatggtttcttaaaggttatttacaatgtggaatctgaaatcatatcggtaaactttttgtgctctggtatattaaaatccattgctctgtcttgcactttgagcagatcatttacccatgcatgattttgtaacatcatgccttggtcacttagaaaatactggttcactgacatgaagaatttccaattcattatatagttttttgaaatcgcatttgttcatatcatcaccagtctcatcagaaaagtctaaatattgggaagctgttgagctcatcgtggtggatacaaatgttccagtgaaaactaattgaaagctagaaatttgtcgttggttacaaatactgtcagttggtttttcttgaggttacaggatcagttggttaatttttgagaagatgtctgccagatacccaggtctggataaccatagttatctatccgttattctttcaagtaaagatggtattatttgaacagagtggttagttcagcttgcagctcagacagttacacaggtgcttttcctggaaacaaatactgtacttcaacacatgataataaaaggatatatatttaaaggttgcaatttaataaaattttactttcattgaggactttctttagtgaaactggcttaattttctatttgttagatcctgagcatgtgatgatgagaaatacaatgatgaatagtacagtttggggccactatgttgttgttgttgttttgagacggagtctcactctgtcccccaggctggagtgcagtggcgcgatcttggctcactgcaacctctgcctcctgggttcaagtgattctcctgcctcagcctcctgagtacctgggattataggtgcccaccaccacgctcggctaatttttgtatttttagtagagacagggtttcaccatgttggccaggctggtcttgaactcctgacccaggtg

SEQ ID NO: 136673 - DNA, 1286 bp, Homo sapiens
tttcttttattgattgtgcttttgatctcatgactaagaactcaaatattatctatgtctatgatccattttgaattaatttttataaagttagggcagagttcaatttttttctttggtctgtgtgtgtccagttgttccaacaccatttgctgaaaagtctgtccttcttccactgaattgcttttgcacccgtgttaaaaaccatttgagcatatttgtgtgggtctatttctggactctttgatctcttccattgatctctctgtttattcttttgccaataccacacaccttgattactgtagctttatagtaagtcttgtatagtgcaattcttccattttatttttttcaaaaatgtcttaattctagtttgtttgcctttccatataaattttagagtcagcttgtccttattaacaaaatttttattggaattgtgttaaatccgtatcaattggggaacaattgacatctttattatgtcaagtcttccaatatatgaacactttatgtctcatttatttggatcttctttgttttcttccattaacattttatagttttcagcttatgggtcctgtacatgttttgttagatttatatacctaaggagtaccttttggttctcaaaagagtactgaggatccatgaaatgttaaaaatattctacataaatgcattgttaatatgtagcctttaaattttattttgtaaacctttattgattagttcaaatattcagccacataatactgccaagtttttaaaataccagcttttgtattgtaattttacttttgtaaaattcttagatttacataaatatctgtatgtgtatatacgcctagagagatttctaaaaggatttttaagggtttgaaaaccctttaaaaatacatgttaatgaattctaatgtaccactgaatagttaacatgtaattaccatgtgctatatatgagaatatgaaagtaaaaggtatatatactttcacgcctgtatcaagttgattgtgtacttataaataagaagggagttaaatttctaaaacacaaaaatgagttctcatgtgacccaaaataatttttggaaagcaaaaataaccattgtatcttcttcgtatttatacatttttagtgggaatttaccatgcttcttaagtcttcagatttattgctgactcttgacaaatagtggatcattagcattgctcaacctcgcctcttctctgttgtgaatatgattgtataaacctaggtgaggagtagtgtgcatagaaat

SEQ ID NO: 136674 - DNA, 1883 bp, Homo sapiens
ggtgttgtattatattccacttacattgccttttcttccattctcactgctttaattcaattcctggtcatctcgttcttagcttgctaatcgatctcccttgtctttgtatcagtccattctctatatcatttccaggattatttttccaaaacaggattaatgtcatcttccaggttaaaaacctcctgtggttgttcatttcttaccgattaaaattcagatttgggagcactgcattaggccccaagccagcctttccaccttctctaccctcagtatcccttgcagaccatctgcctgccgcactggagagcttggcattcctcagggatcccttatgcttgactatctccacactttcactcctgccatttcctctgcgtagtaccatagcccaccacttgtgacatcccactttgtgaaattcttctgccttcagtggtacagtctctggaaagccttcttcactcagctgtccaggcaaaatgtcttactgttttctgcatgctctcataaccttttgtacacacctctgtggcagcacctactgccaagttgattggctctttttccctcacaggccttgagctccttgtgaacacaagctgtgctgtgttgtgttgcgtttagcttcatgtcacctgagcaaagcatagtgccagggacatggctgacacaggatttgcttatttgagcaagggagtgatttttggaaccttcagaaaagctgtgggtgtagtatttatgtttgatggaatacccaattcttactttttattgttaatgacttcacagccagtggatggcattttctaaaatgtcatctttaatctcttgctgtctaaacttcaatcaccttaggaatctctaagaaattaaacttagtcttgcatcatacacatacacatattttgcaggttttcaccttaaaattattttctgtgtttctagcttgttcttgaaccacaggtgtggtattgatcttttcttttacttaatagcacctttcctgccctcacgaccatgaccaggaaactggcttcttagcaccaaggctgattttcaaattcttgttggtttaggttctcttaaaactagtcagtcatatctttttcctattaacaccataattaaatacccagagtacagttttgagaagcccttagcaccatgtgtatatacatgtgtatttgtctggttttacatgctcttttcctagccctagcatgcacaagtgcactcttgcacaagaatgacagagcctagttggcttttgcctccttttggagagctgttatatttattggtcatatgcccagtggacttccttcctgttccatacttgactggtagttatggagcacctaattgtctgacagaagaagatagttcagcagagaaggctcattatagaattgtatggccttgatttcagggaacctgtcccctttgtctaccttcagaatggctatttcccatttttggaagataacttgagtatgtggtacagaattaagtattttcagataatagtaatgcagtatttcatttctgttctggggttgctagtagaagcaactctgtaggaataagctagagcaaaggagtgaacatgagtttagatggcttttctttttgtcagaccatcactagccattgatagaagagctgtacttttgtgttactttccttttgtctttaacagatagagtgaaatataatttgcaacacttggaaccttgtaaaagacaaccaaccaaacagataacaaaccaaaaagaaatcacctaagtcacacactggataaagctttctctgagcagcctctgactccttggacagcagtccctcccctttcagaatcctaacaccctgtcccc

SEQ ID NO: 136675 - DNA, 1051 bp, Homo sapiens
tacttttatcctttctctataattgcttactaatttttttagaataaaggtaaaatgtaatacatttttgaggaccctgttgaaaatcatagtttaatatgatggtgaaagaattaaggggggtagcatactcacagaacagaatgaaatagctgctatcttttgtcttcattgaagggaagagtatgcccccccccatcttccaccctcttttcaaacctaatcgacattctacaacacaaaaccaaggtggtaataaaggaaaggaaatcaaagcaggcttttttcccctctatttaccatagtaagtcaacatttgactctgtcttgatattctataaaatgaatgttggaaaaagaataatatcaatgagtagtttcccatcgaaatgcccaagggccgaaataattgagggaatacttgccaaggtttttcttagttcagtaactcttgatcactgtgcagttgtgtagctgtgctatcattaagggctctccatgtctggaaggacacccccctctcccagctttaatccaaaagtcataaattgtagaactaacatgtcgtctacgggtcacccaggcgaaaacactgcatcttgagaaatctatctttgtgccactgtgctttgaaaatcttttgaatattttgcattaatggtgctcccgcagtctcttgctgggctctctcctcatcttcacaagctccatattgagaagtttttcctcatagttaatctaaacattcttctctctgttctaggcctcacttcttactacatacctatgttcagtgttacatgagtatacccaccttcctttatggttttttcccaagtatttttaagtagcactcatatctccctttcattttcgtttttctggaactatttatttatttatttatttatttatttatttatttatttgagatggagtctcgctctgtcacccaagctggagtgaagtggcacaatctcggctcactgcaacctctacttcccgggttcaagtgattctcctgcctcagtctcgcgagcagctgggatta

SEQ ID NO: 136676 - DNA, 1040 bp, Homo sapiens
cgtagcttaccactactccttttgccttagttttgcttctgaccgctggctattcccatcagcaagaagacctttttaattgaatgtccaaatttgaatgattcttgtcctaatatcattataatcttgatccatttcaaattagagatccctaaggttgacttctcacctcagttcaacaatcctttaacattcagagactttgaaacttcacttctgtttagaatttcatatcatgcccatcatggggggaaaagatggaaaatgtatatgctgagcctataggacctcctgcagtgcttattaatcctttgtggatcatttgaaatgtttctagtttatttaagctttgctgcttgtatcagattgttcctacgaaaaaagaaaaagtgatcatgctttgaatttttaaaaatgatctcactttcaagcaaaagcacttttatgctccattaaagttgaatttgccaaactcttatgtcgcattaacacaagctttactggatagataaatgtgttgttcaaagaccaacttgaactttaccaaactgcttattaagatttttatctttattcttcttatttcttaaattattttaaaataaactagtaaaatagactagataggcctaaaagtactactttaatgacaaagtaatttcttcatttgaggtaaaaaaaattagtatagatcgtaagctaattgtttatgaaggcaaaattaacgaaaatattttgatcacttttatatttttatatttgttttatatagtatcaatatcacaataaaacttgatttttttttaatttgcataagtgatttattgttttgacatttataatttttgttctagtctatcatgcatctttgaaaattcaatattttcttgaaatgtttagtaggtcagccaataaattgacttttttttatccttctcaatttagtgggttttttcaatatgtgtaggacatcttctgttttctatgaatgatagtgttatattctttgtttctatttattttgtgacgattttagcttg

SEQ ID NO: 136677 - DNA, 1060 bp, Homo sapiens
gtcacatcataacctgtaagtaatccatcactaggcagtggctccacagcattcggataaaaatgttttaaacattcctgaaagaagaaaagcccacaaatactgccctgtatattgctgggagagaagatatgagtgcttgtatgtgggaattattcttttgtctttttaaggcaggtctcactctgtcacccaggctggagtgcagtggtgtgaacacagctcactgcagccttgacctcctggtcaagcgaacctcccaactccgcctctcaagtagctgggactacaggcgtgtgccaccatgcccagctaatttttaaattttttatagagacagggtctcaccatgttgcccaggctggtgtcaaaactctgagctcaagcgatcctcccgccttggcctcccaaagtgctgggattacaggcatgagccactctgcctggccaggaattactcttgatcacacaagtcttttatggcagtttgggacactggtcttacatgttgctcacagtgtcatcccatgaaagaggcagggtaggtacacttgcagtatccatgggaacacacccaaaggctgatagggtgaacggcttgcccaaggcacatggctcctgaagcagtgaggtgagaagagatctttgagttggctcctgcccttccattttgccacagggcttctttatctacctcctgcaaggagggcacagtgaaggaaggttcggatgggtttttggactctcacaggcagcctagcctgagggaggctagagtgttcagccatctgaattaatctcgatatcagagagtttagttccctcagtgtaaaattaaaagaatatttcttcatctgctgcaatgcatcagacactatcctagactatagaggctcaaagttgaatgatagcatctcagagctcttgggggctgaggtggtggccttctgtctccctttcttctacctctttccttctttcctccatccacaaactttttgtcctcttatatattagcacgtttggacctcttcctgcacttaaagtcatgcctaccttc

SEQ ID NO: 136678 - DNA, 2939 bp, Homo sapiens
tgagaaggagttaatgtgtcatatatccttttgatttctactctttgagagaaatcacagtatctataatttcggaggcatattcggaagaatgttaaattgtgatttctctatgctgaatcttagagatctgtcagggagtcttcagccctgacaaaataagaatggacccattatagtatcaggtccatttgatttttcaaaagttaagggaaatatgcagatcgtttcagagacttctctttttgctcttgcttgttataagacagatgaagggaagcaaactgggctgtgtttagaatgcatctggagctgcttctctctcgagatctcggcagtataacttctgcaagccctttctgtgtgtatttttcttttctcatcctgaaatattccatcttgcatgagaaagtcagctttgataatttccaaaagctaagtattatgacagaatttgtgcctcttagaaaaaaactgctcctttactataaaatagaacctaccttttatacctgagtaaaaaattctgataaaacttttctaatcgtatttattattgaaaagattatttttgaggtggtgtttactaaaatatgttgatttttatattaatttctgaatactcagtttatatttttagattgttttgtgaattgggatctctgagtataaagtggttttcagcacattggtgatattgaacatcttcctcaaatagcaagcatatgcatttcaacagctttcgggacagtactacagttaataatttctttacaagacaaatgtatgcttttttattgttagcattattttctcatcttatgttctggcatttaaattatgaaacttcatctcggcatgtagacttaccttgtgttgccaagaggaaagaagtggcttttctgcaaagccaaatagtttttactttattgtctgctatgaaacagctgctgattccaggaaaatgccgtctcatcattgggcctggggtgtccaaaagaggcaggaaaaaaaaatgactgtagctccctgtctgccctggcactctcctcctttctctcattttcattgccatgaagagcatgagaacaatattctgcaattaaggattccattaagttgaagaaaagagcaaatgggggatgtttgttctctaagctgaaaaaatttgtctggggtcggggggggggatagtggtagtggtatggagagaggtgggtggagagacgaagtcagggctgtttgttgaatatactgttaaggactgttaccatcctaattaatcaagttagaaattacagctgtagtcggtttccccccaattcttgttatcaattttcttctcttttgagacaaagcaaatataaattttgtgttcatttgtcattcgttctttgacttcagcatctctgaaaataacaatgtagcacaaaagcccagtatttacctagttgtaatgtgggttgccatggtgttttgcaaattattgcaattatgttcaccatgcgagtcgcccttggtaactggcgaaaaaactgataatcctgttttgaacaaaaggtcaaattgctgaatagaaagtcttgattaactaaaagatgtacaaagtggaattatttcctaccattcagaaatagttcttgatcgggtttgggggagggggtgagtaagtacatctgattactgaagtacaaagcattgaaaggatgttgtcttgagcctttcatgtagtcttaatggtggcttttttgtcaaatttacccatttgcggcattgaaagaggcagctgcatttaagctggagagacggtgctttttcaagagttcagtgcatggaaagttctcagcagtatctgcagtttactagtagcccctggtctattaaaactgatgtgccgcatttgagcccattgctctcagtacttgtgaacccctctggctgatgatctaataaagtgctcttactggacaatctctgatcagctacttaaaaaggaggctggaggagggggcctgagggagaagcctcacaggcagtgagtcttggagcaggccagaagagtaaagacaagtggctaaactgaaaggtttgtcaccatgatgatttgtgctaaggcgtttgccacagggttttggtttttgtgccccagatctcccaactgtgatcatgctttttttctgaagagaaattttagttttaagttagataagagattagaagtgtctctctgaatgttaaaatctaccttgcaattgtttcttaaattatggccattcagaaaatatataatcctacattcatgtaaaaccaaaagtttcccatgttgcagccaaaggttagatggatttcttctcttctgaatctggcagaacatctgcagggagtgaattttggagggagggagtttttttttgtttttttttttgttttttttttagtgaccacctgaaaaatcaattctcaaaacttttgagagtgtgtgaaagtggcatgaaagcaaagcaaaccttaacaagtttgtgggtttacattctacatcacctagcaacctcctgactcagccagatctcttgtctacccttagttctgtttacagactattcaaacggcccttcgaaaccatgaaagatattcagtttcattagtaccattctcaaggagaaaataattaaagttaaatgaacaaacattgcctggtgatagtttgaactccattctgattttaagatgtcctttgaggcagtagtagctatagttcagttttaacatttgtcgttcactacccaaaggcatatcacttgaaaccataccaataaatactagtctctgagcaaacaaacaataaaaattacttttagctagacttgagcaaagaaaaactcttctggtaagaaggttttaagcatgcatgccattccaattgaattttgttttatttg

SEQ ID NO: 136679 - DNA, 1067 bp, Homo sapiens
tgggggctctttaatgtacctcaggtacatcttctgatgctcaagctctgattgcaaattaaaatagcaaggctctgtattggatttgatgtgaggcaaagcagaccaagtcgctaatttatcatgtaatatacaatcgctgaggctggaatttgtccacttgtagtgctattctgtgtgtttaaatgaggaccactgtttgcatccaacctatcataacagtttgggagtgctccattatcctttcagcaaactgatggcagagtctggtccttgtacaaatgataagatcaataagtttcaaataacttggatgaaatgacatatgactgttcatttaaagagatgtcttacttaaaaaatcaattttaataatatttaagattcttacattgaccgatgaggcactttctacttctgttttgataattttgttcaaaatattcttgtattaacttcggtgaatagttagtttatgtatttatttttcctgatttactctttcatctcctaccctagtacctttctgggacttaataatcactctttgacatgccagcatgctgcagtgtagaagatttaactttaaaagcaaaattatattcctgttaaaacttcccctggagatcttagggaaattttctcccagttttgggtacaaatgtgggtcagaaagcaatttgttttttgatatttctggaaattccaaatcacaacatgtcattcttcaaaagcagctgtgggcccatactgtgcactatctataaggagacccattttttgccactggggataattctgtggcagaaaaatgtgcctgcaagggaaccccggaacatttataaatggtttagggtgaaaagagagtctgatgttctcagagtacatctagttttggtataggggtggttaatggccattattgaaaactagtaataatctgatgaactcaaagcatgcatgctgccagaccccgtcctgtgaccctgtcactgcattcctggtgagccattacaatttaaactaaatcgtacgtcactgcagaaccatgctgtctcttgaaaatc

SEQ ID NO: 136680 - DNA, 1090 bp, Homo sapiens
tatgccaaatataatcctagacactctaaatgtgttccatcattgcaacaacggtatacggtaagtactgtggtatccattttacagagaaggaaacagcacagcaattaagtaactagccaatagtcactcagctattgggaaggttatacatgtatgtggtgcattctttggtaatggtctttactaatgaactaaaacacattggtttacattctgcctgtagtagaagtttttgttgggaagttttgatgtattggagtgaggaagggtgtttcttttaagaaaaaaaaataacatctcatgtgattttcttttttttttttttaacttaatggttttcctaacttctaagtttggggcatagatctatctaattaacatgtcaggagagagagataactagagttatgtcagaatttctgagaaaagattaaataaaatgagtctatcttgataaccaaaaaaaggtttattacttgtatttgtcgatggtgataagtctgaagttttcccttctctccagggctggttgatatgtgaagagccaacctgtcgcaatcgaactcgtcaccttccccttcaattctcccgaactgggcctctttgcccagcctgcatgaaagctacacttcaaccagaggtaacagtctcataatgctaaagaaccatgtagaagagggtagagggctgcttgctttgagaagtagatactgagtatttgccctatgaagatgccctactaccatatgcatatactaatcttatttttaaaaaatacagatttcagaaagatacatgctttctttttttcacatgtcatgagcaatactatatttatatttaaaagggaaactgactaattctcatatgagttatagatttctttggttgccactacataattacaaaagaagacatggccattccattctagaaactgctatcgtctttgggcttgatcagaatcccatttgtaagagccagaaatcctcccaattctgtaccctgaatggtttattttgtggggtttttggtcccctctgctggattaattgtttataagtagctgcatagatgagtagttctg

SEQ ID NO: 136681 - DNA, 1031 bp, Homo sapiens
tttagtagagatggagtttcaccatgttggccaggatggtcttgatctcttgaccttgtgatccgcccacctcggtctcccaaagtgctgggattacaggcatgagtcactgcacccagcctgttttgtctttttgagatggagtctagctctgtcgcccaggctggagtgcagtggcgggatctcggctcactgcaatctccgcttcccatgttcaagcgattttcctgcctcagcctcccgagtagctgggactacaggcgtatgccaccacacctggctaatttttgtatttttagtagagacagggttttaccatgttggccaggctcatctcggagtcctggcctcaggtgatctgcctgcttcagcctcccaaagtgctgggattacagacgtgagccaccgcacccggccactcaagccatttttctaccttaatatacacacctgaggtgtaagacatactatcattaatgactcccaactagaaagcatggcatctggaaacacttctctggtaattaagatgccttccctctgttgacccctttgagcatcttcgacccaaacagcattttccaaactgtagtgagaagtttgcaggttctttgagcaaagagggttttgtgatcaagtatatctagcagatgctgggctagctaaaattaaacaagtttattgcagatcttttcagaacctataatatgataatgtgcaatctgtctcactaggacaggtccataatgtgcctcactttccaaattcgtctagcctgaagatttgtaaggtttttagtgagaagaaggtgagacttgggaacctgttgtttatttacttacttcttaaatgcagaggcaggcctataatcaagttttgacttcaaattttcctgctgaaaagggttgatacacagactagttttagaaaaatatgtacacacagttttagaaatggagtcctgctatgttgtccaggctggaatgcaatggctattcacaggcgcaatcatggctcactacagccttgaa

SEQ ID NO: 136682 - DNA, 1011 bp, Homo sapiens
gctgctcaggacatgaccctatggagttactcagtttcagagcaggctggttggtgatactttccttagccattcctgacagggaccttgacagtgggactcagaacactcttatgtactcgattttgagttgctaataatgggcgaggaatttcttaattctatttgtgaggttcctgggcttttctagtaggagggaaaaatgcatttttccaaagatagttctagagaagttcaaaaaacagttgtgcaatggacagaattattgtaatcatcagagggttttccaaagtatctattctgcaggattatactcatctggttctcaagttctcagttgctctgtctcaatcataccttactttcatttaataattatttattaaacaactgcaactacatcctaggcactttgctaggtgctagaaacatgttaatgaacagaacatttctttatttataaaactattttaacattacacagattatataaaattctataaagttgatatctgtgggcaaaaataggcatttataaatgcccatttggacagaacactagacattcctagtgctagactagtgggagctttaaatatgttgttcaagtttgatggtaaagcactggcctcttactgtgccagtcttatctgcacataataaacctattctcacttagtcctgggttgcagttgacttgagtactttccagaattgacttggagtaggaaagctggctcttctgctggctcgcattgccagagttagaagaagaaagccgggacagtttttttctcagggttttacacgtgtatcttctctcttctcagatatttcattcatatatatatatatatctcacagttaagttttttaggctcatggaaattcccagtatacaagttgctgcttaagacatatattccctgagtattttttgctatataagaggtgcatttaaatacgagagtgaaaattttgatgcatgtttaagttactaagtaaatagaa

SEQ ID NO: 136683 - DNA, 1151 bp, Homo sapiens
ctcattaacgtattcattcttgatgtagagctgagaaaatgtctgtatgtgactctcacgatcatggtagaaataatctgtcgaaactgtatagtccctggggcaggagcagtatagtggagccctttattcaattatttaatcaactaaatttcttgaaggtcacttataaggaaagcagtgaaatgacttctagtcctactttgagaaaccccctagtgtttctcacattttcctcacttgtaaaattgctaaagtctattataacagaacacataatgtgtaccattgtaggacttctgtccttaaagggagaggagaaataatgaacttataatcattatatgttaccatctcaaaatggctatggctgaacaaattgttgatttgatgagtaggttagggacagtgagaatgttgccaagctacctggggaagtttcttttttcagaagaaaacatgaaaataattgtggtctcttaaggcagtaagcatgagtccgtgtaggaagagaaccttagaactatgacctaaagtcttaaacctagtcattggttattctccagtagggaatggtggtttaccatgaagggtcttttggagctctcctttgttattttgacatgcatatttgatgcaaagagattactaaattctatttacagcttctcttactgccacatgggtgctagcaacctttttcaatttacttttttttaattggggtataattgacataacataaaattaagtgttttaaagtgaaccatgcagtggcatttagtacattcacaatgctgtgtggctaccaccagtatctagttccaaaacattttcatcaccccaaagaaaattccatatctattaagcagtccctccccatttccccctccttctagcccctgttgtcactatggattgtacctactttgaatattttctgtaaatgaaattatacgatatgtaaccttttgtgtctgacatctttcacctcgcataacatttttgaagttcatctgtgttgtagcatgtattagtacttcattcttttttatggccaaataatattccattgaatagatatgccacaatgtgtttattcatccattgatggacatttggattgctttgtcagtacacttttaaagttt

SEQ ID NO: 136684 - DNA, 1453 bp, Homo sapiens
atgttcagatgcccattagggcttccttttttccagtggaaattgcagcatgttaattttcacacaaattacagcaatagcaggtatctctatttgatacattataacaggagcaatcaaggataattgagtgcctttcagatggaaacgggtgcattcacttcaattcaaagcgagtccatttatcgcctaatcggtctttaaacactaaatttctggaacaaaaattcttgtcataattttgcttaagtgtatttggaaatcacagtcctttgagcaaggataattgaaatcaaatccctttcaatggaggtgacatttctacattttcccaattgaaattaatttcaaaaattgagcatgaatatcttcaaatggcaggcaattatagctttcaatgggaagaaattatgcgcacaaaaaagtggagacatcaaataccgcttcagctaaatgtctttgtttccaactgtgtttgccttgtaaagatttacatatattgacttattatgcaaccttgagatgcagatcgccttcctttttcatctgagcccattaaaattaactaaaattggaacgttcttgttaagcttcatcaaaactgtttggaatttactgcagctgcagaaatgtgttcataatagaacttaacccttcaaagacttgaattctacccccattttttttaaatctggaattctaacttcagcgcatttcattgtttcacttttaatgattcaaaagaggagtggtgaagaactgatatgctaattgtcttctctttttgtcatctggtacccatgggatctcaggtaaatctctggagcctgtcccctttgaaaactgccctgaaggacaatactgagttcccagagggcaccaatatgccaacctttaatatttaaatgtaatcatatcaagccgatttcccactcctcacaataggaattgctcttattgttggactgtgacaaactctgtgggtttcctgctgcggaccttttcctactaagaaccttttctcccaattgttttattgccacattaatgctgctattaagatccgtgtgctataaattagataagctttatatatttttttattcatcgtgactttcttctgttttccaagggtaaaagtatattgagaactgactcttgcaagcacttacttttcgaaagtagtttagaagcaatctagccatgttttacagttatagcggcaattgtttcaacaaccccaaaaaaattgcattactgaaatatatttcatgggtgcaattggccagggacagggagggcagcaggccatttcttttattaaggtcttgcgcaaatgttatgaagagggcagtatctcaagaaacaatttcacagctggtttgctcctaagccactcaagcctaaaaatgcaccgaattcctggtggaaaaaaaagaaatagatgtcactc

SEQ ID NO: 136685 - DNA, 1099 bp, Homo sapiens
ggtggaaactgagatttccaaatcctcctaggttttagggcagcactctttaaataggatttctgagtcccaaatctttcttatatccttgataatttttatattatttcttccttcagacataaccttgatatgggctgtgtgtccttggaatgccaagcagagatcattttatgctttgaggtcatagttataaataatgttacttatcatatactccaaattcattcagaatttagtgagcacctactctggaccaacactgatacagccagtaggtatacagcaggaatctaaaattaagtccctgtcctcatggaacttacattccagtgtggggagacagataataaacaataattatatgacatggcaggtagtgacaaagtactgtggagaagaattcagctgtgtgagtaggaaagggactggcacaagtagggtttgttaatttatgtagggtatctagggaagttctccttgaaacagtaatagtaagcaaaggccagagggatgtgaaacagtgggccttgcagatatgaagaggaagggcatgtataagggatctggaacagctagtataaagggcctaagataggagggtgcttggcatatttaaaaaataggaaaagggccagtgtagcaagagaaaagggaacgatggggaaagccgaaagaggtaaggtgagagaatttgggcagagggtggagacactgtgaagagccatgtaagccattgtaagggctttagtatatatgctaggggaaatggggagctattcaggaattccatgtggaagagtgcagtatctgactaagttgactgctttgactgctgtaatttaggcaaaatatgttgatggtagcttggcccaaggaatagaagggaatctgtgagaagtggttagattcttgatgcattttaaagctaaaactgataggagttgctactccaatccttcttcccctgtgacgttatatagaaggaaatggaggagagattccttcttacaggctactgattctcaattgaattctaatgtatttaattattcacctaaaactaagatcttgcctatggaccccatatagcatagca

SEQ ID NO: 136686 - DNA, 3137 bp, Homo sapiens
gtggtatcagactatgcccttctttttggatggttatagattaaaggaaaatcttctagggcaaatcttgaaattaagaaagtattaagggtgtgctccatactctgttccttgtttgtatccttatgccttgtccttccaccagtcttccctctcctcttcctttacactcagctgtcctgtaatgcaatgtgtgtgttcctaaaaatcactaagctatggaaaatcatataatgacaaccacacagtttatggaaaaacagaaaggttagggcaacacacaaaaacttcatcagtgacacataaaaaaggatataggaacctaaacaaaaacaatgacatagttttacacatcttcagtagctaagaaatatataaatattacaataaatatggtactttaccccgaaaaagacttgaagtttgcttgtggaagtggactcagaaggattgcagctgtgagtcatgatgacgtagagaatggaaggttatctgaaattggaaggaaagttgcaacaaacaccagatgtgggtgagtgtagcacagtgaactgaggtagctggttgatgtttgaggtatttgcgtatgtgtgttttatgtattcctgtattgcttgggtgcatttcttgcattcacctaatatttcttgcagacaaaatcatgcacgagcaaacacgaaattcatgttgtgttcaaactgttccgtgatatatcaatggcactggaataaattctcatattcaaaacaagcgctgtagcagaaccaactgtatctcgttttgtcttgatgattaaccagcaccttaactgtctccctgctttattgttttctcttcattctcataatgtacaaagacactcgtatttttagaaagactgattggaacatctgtcaaccagataattaaacttattgaatattgtctatctccagcatcctggtctgggacgtgggaaacaaaaaacgttttgaaacaatgggttctgcctttatactgcttgaatatggggaactaagcgcagacctttgaagcaaaacaacagttcttaaaatatgacaacatatagaattaatacatcagtgctgaagagatagggtaaagtagttagtaaagagataggataaagtagttagtaaggtaaagcttcttagaatatataaattttgatccagattgtaaacaaagttgtgaacatggattggggaagtagtcccagaagatgaaaaccctagcatcaaattctaccagcattttggttccaggtaagatggagtaagaatagttcttattgtctccaaccgaaagcaactgtaaaacctggacagcatgggtggagcagttacatggagaccgaaaagtaaacagtagcaggtaggttaaagatgaagaccagatttcttttttttttttcttttttctttctttctttcttttttttttttaagaccggttcttactctgtcaaccaggtggagtgcagtggtatgatcaaggcaccctgcagcctcaatctcctgggctccagtgttcctcttgcctcagcctcccaagtagctgggactgcaggcacttggcaccatgactggctagtttttttattttacttttagtaaagatgaggtcttgctatgttgcctaggctggtctcaaactcctgagctcaagcacaccccgacctcccaaagtgctaggattacagacgtaagccaccgtgcctagcgatgaccagatttcaagtacctttaaactagcagtaagtttgccattttgtcccctgatattcccctgcctaaatgcagcacagcgtaaaaccaagcgtgggcaccaagctacagacagcaagttccaggagaagcaagtagtggcaaaggtaacacccagagagaatgtagaaatccccatggctttcttttgttttttttttttttcttcatgccctcatgcatcagtcttcaagtaaccttatggtggcaacagaagctgcagtgagagtcagcaggagccagaactccaaggaagggaaatctcttccctgaatcctctttctctttcttcctatccattggtcctaaatggagtacagtcacaaaaatacatgacaagttagataactaaagacacagctttctgactggaggactgaaaacaggagttacctgcagggaactagaaggtaccaggaagatgacagagaaagccttagggaaacaggccccataaggttgtttatgagtcgggtgcagtgactcatgcctgtaatcccagcactttgggaggccaaggcaggaggatcactcgaggtcaggagttcgagaccagcctggccaacatggcaaaaccctgtctctactaaaaagacaagcgttagccggcgtggtggcacacacctgtaatcccagctacttaggatgctaaggcaggagaatcgcttgaaaccaggaggcagaggttgcagtgagccgagatcgtgccactgcactccagcctgggcaacagagcaagactctgtctcaaaaaaaaaaaaaaaaaaaagttgtttatgaacttctgggcctgtggaaagaaagggtctaatcctaatcaacataccaaagacatggagaactgaaataaaaaccatcacccagaacccaggactacctagtagtgcacagaggagacagatccaaaaaactgcaaaagttttgacagctgaactgacattggcgacacagaaagtggattggagctcacagcccaaatttaatgaagtcaattgcctgctaaaatgaaaataccaacaattttcataggattgaaagaagaccctgagactcatactattcaaaatatccaggatataattctgtaagatagaaccaggaaaatcctataagaagaaccaggaaaatcacagattgctggggtgggggggtgggggtgggggaggagacggaacacgaacaaaaagatgccaatgctgagatgataataatattagaattatatgataaagactttaaggcagttattatccaaatgttccaacaagtaatggtgaaccccccccccctttttttttttttttttgagacagagtttcgctctttcacccaggctggggtgaagtggcgcaatctccacttactgcaacc

SEQ ID NO: 136687 - DNA, 1812 bp, Homo sapiens
tataattaccaaagcaaaaaacttagtgggctcaatcatagaatggagacgacaggagaaagagtaaatgagcttgaagatagatcaatagaaattatccagtgtagacgaggcatggtgcctcatacctgtaaatcccaacactttgggaggccgagccggacagttcacttgaggccaggagttcaagaccagcctggccaacatggtgaaaccccatctgtactagaaatttttttaaaaattagctgggcgtggcggtacttgcctgtaacccagctactcaggaggctgagacacgagaatcatttaaacccaggagtcggcggttgcagtgagccaagatcatgccattgcattccagcctgcgcgacagagcaagactctgtcttaaagagaataaaagaaattatccagtatacagaagacaggaaaagactgggagggggaaaaaggagccttggggacctgcggaacaataacagaaaaatctgacagtcatgtcattggaataacaaggaaagaaggaccatagggccaaaaaattatttgaagaaataatatttgaaacgtcctgagttgggcagaagacatgaatttacagatttaaaaagctcagaaccccaaacaggataaaataaatttattcccaggtaaagcataataaaattatttaaaacaaaaaattctgaaagccagggaaaaatgacatatataagaaaaaaagatttaactgatgatatatttctcatcagaaaccctggagccagaggaagtggaacattttggaagtgtttaaacaattatcagtacaaatttctatgtccagcaaaaaatactcttcaggagtaaaagtgaaagaaagacattctcagatgagtaggataattcattgccagccgaccagctctgagaattgctaaaggaagttattcagagagaggggaaatgaatgctggaggaaacttggaacatcatggatgatggaagagcaacaaaaatgggaagtataatagactatttttctcctcttgagtttgctgaaatatgttttgcaggtgaaaacaaaaatcatagcattgtctgatgaggttttcaatgtacatagacatagagacaactacagcataaagagagaaatggggtctatatgtgtttttgcattccacttgaagtggtaaaattttaattctaagtgtgtacattgacattctgaagtatagactatataaagagatgtcaaaatccaataatagctaaattataataaaatttgcaatgttcaaataaccaagaagagggcaggaaatgggaaagaggaaggaataatcagaaaataaataataaaatggtagccccaaaatgatttttttttaatgatgcaactctaagctgccttcaagaaactcactttatttttattttttattattttactttcgtgtaatttctttttttattattattttagggtacacgtgtacaacgtgcaggtttgttacatatgtatacatgtgccatgctggtgtgctgcacccattaactcatcattttacattaagtatatctcctaatggtatccctcccccctccccccaccccacaacaggccctggtgtgtgatgttccccttcctgtgtccatgtgtcctcattggtcaattcccacctatgagaacatgcggtgtttggtttttttgtccttgcgatagtttgctgagaatgatggtttccagcttcatgcatgtccctacaaaggacatgaactcttcattttttatggctgcatagtattccatggtgtatatgtgcc

SEQ ID NO: 136688 - DNA, 1011 bp, Homo sapiens
gaagttgcttatcagcttaaggagattttgggctgagacaatggggttttctagatatacaatcatgtcatctgcaaacagggacaatttgacttcctcttttcctaattgaataccctttatttatttccttctcctgtctaattgccctggccagaacttccaacactatgttgaataggagtggtgagagagggcatccctgtcttgtgccagttttcaaagggagtgcttccagtttttgtccattcagtatgatattggctgtgggtttgtcatagatagctcttattattttgagatatgtcccatcaatacctaatttattgagagtttttagcatgaagcgttgttgaattttgtcaaaggccttttctgcatctactgagataatcatgaagaaactcactttaaatagaagaatattggtccattaaaagtagaaaatggcaaaagacataccatgcaaacactaatcaaaaggaagttagagtggatatattagtaacagaaaattagacttcaggttaaagaaaatgattagagctaaagaggaatactacataatgacaaaagagctaagtcaccaagaataacaaataattctaattgtatatgcacctaacaacggaggttcagaatacctgaagcaaaaattggcagaaaggaaaggaaaaatagataatccacaattatacttcgcaagcgtgacactactctctcaacatttgatagaaatgctggacataaaatcagggatatagaagaactgacaatctgattaatatttataaaacatgctctccaacaataacaccatccacattcttttcaagtgtacatggaacattcaacaagatagaccatattctgggtcataaaaccttaatgaattttaaaaaattgaaatcacacaaattatattcttgaaccataatggaattaaattttagaaatcaataaaagagtgataacaggaaaatcttcaagtacttggaaattaaacagcac

SEQ ID NO: 136689 - DNA, 2232 bp, Homo sapiens
cacctgtaaccccaacactttaggaggttgaggctgcagtgagcagtgactgtgccactgcactctagcctgggtgacagagtaagaccctgcctcaaaaattaaaaaataaataaaaataaaactgtgaaaaagatacggctccacacctattagaatggctaaaatacaaaatactgacaataccaaaagctggcgcagatgcaaaacaacaggagccctcatatgttgctggtgggaatgtaaagtggtatcacaaccccagaaaaggttgacacttgcttataaagagtaatatacacttaacatatgatccagcagtcctgttcctgtgtatttaccctaaagaagtacaaatttatgttcatacaaatacctgaattcatatatgaatgtttatagtagctgaattcataatagcctaaaactggaaacaactgtaaagaaactgtagtactttcctaccatggaatattgctcagcaatataaaggaaggtactactgatacacccaacatcttggatgaatagcagaggcattatgctgagtggataagccaagactcaagggtacattctgtatgattccatttcttgaaaataaactataatgatgtagagaacagaagagtggttgtcatgggttagagaatggtgtgaatacaaaggggcagcatgaaggggtgtttgaagcatggtgggactattcttcagcctgattgtggtgtgttacgtgtgtttaaaaagtcgtggtaaggccaggtgtggtggctcacacctgtaatcccagcactttgggaggccgaggcgggcagatcacctgaggtcggtagttcaagaccagcctggccaacatggtgaaaccctgtctctactaaaaaacataaaaaattagctgggcatggtggtgggcacctgtaatcccagctacttgggaagctaaggcaggagaatcgcttaaacccgggagatggaggttgcagtgagctgagattgtgccattgcactccagcctgggcagcaagagcaaaactctgtctcaaaaaaaaacaaaaaaaaaacagtcatggtaagccgggcgtggtggctcacacctgttatcccagcatcttggtaggccgaggcaggcggatcacccaagatcgggagttcgagaccaacgtggccaacatagcaaaaccccatctctattaaaaatacagaaattagccaggcgtggtggcatgcgtgtgtaatccgagctacttgggaagctgaggcaggagaatcacttgaacccaggaggcggaggttgcagtgagccaagatcgtaccattgccctccagcctgggtgaaaagaatgaaactccatctcaaaaaataataataattttttaaaaaaagtcatggcatgactttttagccaggcacactagcatgtgcctttaatctcagctcctcgtgaggctgaggcgggaggatcgcttgagaccagcctgggcaacatagtgagaccctgtctcaaaaaaattttaaaaaaatcgtggaactgtaccccaccagtcagttttactatgcaataatttttaaagtaagattttttttaatagaatttctgtggcctgataagatataattctgctttaagaacttctgtgaatgtccaacattgagatcatcacaaggtaattcccaaaactgccacactgaagacaaggcacacctaaataaatgtcactgggagcccctgctaaactttttggccaggaatccataccaaggaacaagtatccaactatgacaaaggaacaaaacattcatattctctttgctaaagcacatttgtgaaagtaaaacatctccccccacccccgcaaaaaaaaaaaaaggaaagtcattcctaaaaattgatagaatagatttggacatcagagtgtcaggccactcatgcaagttctagcccttcaaataagaatgtaaagccgtaataacatgacagcattttgaataggaaaatctggatttgtgaagcagtgtgtgtttttgacaacagtagttccgcattcttttatgcaacataaacatcgatttgtttaaagttaccattcttttatttatccagcgggagcatagatagcatcatagggaaaaagagactctatcctgatttgttttctctttatttcactacagccagcattctggaacccctttcaaacatcccttcctgtgggttaagggagattatttaa

SEQ ID NO: 136690 - DNA, 1049 bp, Homo sapiens
gaaagtgtcaaattgacattaatctatcatgctgaacttcattaagcccctcctttggcatactgtgatttaatccatatatagcgtgcatatatggactttattttatcttgctcaatcctagaccagcatttcatgccaagaagtgagatgatgtttggaaataaaaatatgccgccttctcgattctagctatgaataatcattctagttttgactctaccagtttttctaagaggtttcaaacaaaccatagctaccccatttactgaccagatctagtattataaacagatgacttcaccttgatgaactttgtaaaataagggaaataatcccagtttcccctgacctcacagagttattctgaggattgaatgctttgaaaaatatcacatactatgcaagtgcaagggttgtgaattttttttattgtttagcagagtaattcatttagttattgaacaggcatattgataaaaatattgtcaggaataaaaaaatgaatatgaccatcaaagacctctcagtgtagcatcggaactaaaacacacaaataattctattagaaaatgaaaagtgatacatgccattaaaaattatagaaagacagtggttgacatgaagagaggggtatataaatggaaatatccacatttaactgtgtcacagtattggagaagatgtacccacaccatactgtaagcttctgcaatctttcagtatttttctcttgtcccctgatgtagccctagcagctagaacagtgccttcgcatgtagtagattctcagtatgttagataaatgaatagttgtctttctgatgaatacaggtggctcatgctatgagagtaggctgactttaacttaccctacgtttccatatgaagcagaacttcttcagaggtgtcacctaacccagaatgcaccttaacatccagatcaaattaaaaggttaagttttcatcctgatgttactccaatgtatttatagtagccatgtatatttattttagtcattgttgatatttgtttatcacagcaccaa

SEQ ID NO: 136691 - DNA, 1672 bp, Homo sapiens
tttgaaaaataacttcatctttacaaaaaaaggattctgaaatgaagaaattactgtgtgttttttaagcccatcgttatcaagaacttgctgtaaattgtctacttgatggacatactgaatcagatgataatgtgcaccaccattctttctaatcaaattaccaaaaagacttcttggaaaagtaaccctcacaagcggctgattaatgaagtggtggcaatgttttgtattagaactaattgaagtaatccaaataagttatttctgtagcctatggaaataatttcctttgcaaagaagtacagtggagttggcaaaccagtatttttttttcaccctctgttgttccacatttgcaaaatagctaagttaacatagatattgcaaataaaatagatagaaaactaagtaattgagtggcagggaaaacaggaaagtttatttcaaccttttcataatcaagacgaataatttacctaaagcctaaaggtgtatggaaattgagcgatactggaattcgaaggcatatctttagtaaaatgctgtagaaatagcagtttttaatgcattcatttaaaagagacactcatgttcaagagtttagacatgttccttagacaaaactttctggagaacctgtggctggcatggcattgtgtttggtgcacaaatcaaaccctccagaagcttatcgtctaattgggaaacgtataggatctatcacatatccactgtgtacttcgtagcagtcatggtgctcggtgctttttgtatggtatcttgttattttaacaacattcctgagacacgttagtcttgttttacagatggagaaattgaggtgtgaatatgttaagcagtttgtcaaaggtcacccaagcctttagtggtagaactacatttcaagccagattcagtctgaccccaaagcctatggtctttctgctattccagtcttccatggggatatacacataggacacattagaaatcaattcaaaggactagtgttgtatcattaagcaatatgcatgtggtccccgccctcagcagctcacatcctaggaggctcaaggggtgataaaaccagtgaggactacctggggtgggagctgtaggtcagagggtgtagtgagccatgtggtcacaggataggcaactatgtctgtcaggtggaaagtgaacagacagaattatggaggcacaaacggcttcccgaagatgatgatgactgtggggtctgatgaggtggataggaactgactggatctttaatcaagaccagaaggatagacctgaaaggggtggaattgcttgggtaagggtgtggaggaaggaaggatacatttcctgactgtagcaggggatggtgataagggtggcgtgggtatatggccaggctggcagttgaggggcatgtagaaaacttgtgagagtggacctgaagggttggaactttatcctgtgtgtggtgagggtgctagtagggatttttcagcaaagactatcctaagctggattttcatttctagacatgtacctcatgatctctgtcagtgctagtgaggtttagagttctgaatctgctatatggtatgatacctagatttaactgtatcttcaccatttgcaaagtaatgcagtttaatacaccttcattatattttac

SEQ ID NO: 136692 - DNA, 1048 bp, Homo sapiens
ctatcagtactttttttaaagctcttggggtgactggtttgcagccaggtaagggaccactgatataggacctcatcagaaatctcaggagagagactggataatattgataaatggattcaggactatgttttggtcataaagtactttgacttggagaaagaatgaagtttgcgttgtttctaatataatctgattacaggattcaaaaagaacacataaaaaacggtggtattaaagcattttccttttcccttcatttcttcaacaatatttgccaagtcgtcccctgtgccaggtatcaaaacagagttctttccttacccctgtgtgtatatggacctatgagtgcacccgtggcccacccttattactctggtaacactccaagtaactaacttgaatgcagagcgtgatacatacagtagctatttcagctcagtattgtccttaccaaatcacagtcggccactttggtacatgatgttctaactataaaggaagactgaaagaagcctaggcactgtgttgagtgcaattttcaaggaaagagcaagaaatcgaacattttaaaccaataagtgaaagctggagagagaaagaaatgttaaaatatcatcttattttcttgaagtattttccatccaatcttgtacagtcaaaatgagcatttaagtgtgaggaaaaaaacgctgaagatctcagataagactagagagtgtcaggtttcttgattagaagaatttatcatcaaaggcaaaagagaaaagatggtaaagattttttaaaaaacaaaaaatctccaagggatcacaaattagtggtgcaaaatcaagacaacaaaagtaggtgttattcttgttcatttaaactatagttttctctgtttcatgtgtgttttttaaaaccacttaattgtatttgacattgaaaatgtaatagggccttttgttttcaaccagtttactaattgcaaaatatgtcaggaatcaaaagggcaggaggtgttggtatatttttttaaaatatataactcctttttaatttt

SEQ ID NO: 136693 - DNA, 1038 bp, Homo sapiens
cacacaatacattatcaaaacaaactattatgaaggaggtaatttcagtgttctattcaacctgcagcatgtgtgcagtcagggagatgtgtaccagcaattactgctgaatctaaaaaactaaacaaataacttaatcgctgtcgtcctccttttttttcccccaggaagcagtaatcaggattcgctaaaaataactggtgtataatagtataatgatgatgcatattgtagaatagctaataagaaataaaataggcttctaggtgtatactttttaaagtaggttcaggtaaagaaagagagacttgtggaaggaatgcgcccacaaaaaagacaatagccctgaccgataaattgctccatgtgggtttgttcctgctaccgaatatttatagataccatttgtaatggccaaagaagtataaaatacactaaatttagtaacacattttataagggaatgagcagaaaggtgaagtgtgagctctaataactgaattttagttactcctgcaccaaattgggttggctataatttttcatcattaagacccagctaggatccttggatctaatacttggttactcaaagagattccctttgaaaatagtgctatttccatatccagttgtagatagtggttttccttaatttcttatttacatgatagtctgtgtgtgccacctggccttgctgcatggattgtacaaatgacttggctgttgtggtcattcataaattcattcattcaaccaacttggcacacagtgggtgttcagtgttggttaaattacatgtcattccaaggcagcaagggagaaactggtaacatgtttgtcatttgatcttctcatttgaaaagttctgagggcttagttgtttcaccttggtaggacccctcaaagaaaacaccaaagcttgagctcattgttccccagctcgcaagtttcccaagtgtctaaccccttgggaagatggaaagaaagtttgtaggtcagttgatttaaaatagatagaagtgcatttgaatgtga

SEQ ID NO: 136694 - DNA, 1633 bp, Homo sapiens
ggcaatggattgtcaccacaaatcataaaacggggctcatggtatagcaatatgtattaaacagttttcagaatttgtttaacttcctgctagcatggacagggcccagttaggaagcacatagcacttttcccaattaacagtgcaaattgtcatgagtgcataggaatttgcagtttgacaaaatcaggtttttgacagcaggggtaatcagtctgcagcttcgcaagtagtaatctatgatcgaagtggcaggatttattctgaattatgaaaggtgtatatgctatataagagggacaaaccattagtatgattctgcccttcttacccactttctttaaaaaatgctgcttgatttggaagttgaaagtaggggatacactctgctgagagtgatccccatcgcttccccctccccagtagtagtattcatttattttctgttatattacagtattctgacaagtccctgtacacccagctgtgcttttaccggtacatttttgatgcggagtgtgcactggagaaacttactaccgatcatgagaaaggtacgttaaaatactgtaattacctttgagtttaaagtggaaatttgcattataaaagccagacctactgtgtcaggctgttcatgcagcatcacattgctgtctcagaagcaggccgtgggggcctatgtgaacacagggatcccctgcatgaggggcggtggcataggaatccccagctttggcccccacagcctgtttcacattgtcctctattaaagcaaggctttgggggaggaacagtacaaaaaggactctttaaatgctatattttgaaaatgctattttctacagagtttagtaactgtaataaagtaagcataggcaacgtgatcattgggcctacaaaaaccagatattactgcaaaaaaatagacttggagtgtgtctctgctgttcgctaaaagcctgggttcgttttgagagagggatgaggtggagttcctttattgactccatcctaagagagtatataggcgcctcagcccgtatgatcagctgttgcatggaaccctcagcactcggcgtttccttatacaagacttgcgggcactgtgggacttaatgggtctgggaaaagctttgttacataacttaaagtatttgaaaatgtcatgacaactgcatgtttgttttttttttctcctacctgaaaatcacattgacaacttttctattacctgtgaaaaataaaaaaggcagatttatacatttttcttattagttacctacagagtgtttatgttgtttgtcagcgagtatcaattcaacgttttgttggtcggtactagggctggaaacaaccgcaatgacattaaaaacctacaactattgctagatttccccgcataagaatccccatgctgcccttgatttgttctcactgtttttaattccagtcataattgacttgtttttccatccacaagataggctagaaattattttttaaatgccttgacttatttggttttgctgtccttggagagagagcattttacaactgatggagaagctggttcagatattagtatcttatctctagatgttcaacaaggacttgagctatctccacagca

SEQ ID NO: 136695 - DNA, 1951 bp, Homo sapiens
ggtgggatataaaccaaaacttgggggcacacttaccaagagcagaggtttcctaacacatgacatctgataagccctctcctaagagtcacctggggcatattaaaaacccaaatccatagatcctatgtccacagattctaattcagaagatgttgggggtagagcttaggaagctataattttttgaaaattcccccagataattctgccgtgcagccaagtttgagaacccctctcctgggcactctaaagacatagttggatggtttctaaataaaagacaattgaatgcaaggtcatagttcatagggaacaatgggggaacaagaatattcttatagtagagaggagaacaattataggggaaaacaccataagtttaaaatagtataacaaataaaattgacttctcactttataagttggagtgaattctcttttgatttgctattcaagggagacctgctattaaaatgagtttaaaatctaagggaaccggagggcaaatatatttattcaatttggaccatggccagaacaccagtagatgttaacatcaaaagtcctgtgaaaaatgacagtcgttatacacagttatattattgagaatggagtctaagtgtcttctgtcaacaagtgccccgtaactggtgtgtgaagtatttactgtagactctcctttactgtcagtacctagcaacatttccttcactaagattgttttaccatttccatcataaagcccatattttaagggttgtaactggatggtggttttaatttttgtttgaaacttggcaatttgacttagaaaaacatgtacaaattatttgaaagaggtttatttttatggggaaaagtagctcttgtcaaagctttttctctgctttgctttcaaacgagagtttacagaccattagtccataatgtggattaaccccatttgatattttttccttcctttaaaatggtaaaggactgttattcacgttggtgaagtgtttactgcatatttgctgtaactgcattacatttttaaaatcttatttctgtgggactttggcattattattgtaactgctccagaatgtacacagatggcataatggattcaaaggcggttttacaggaacataggggcaatctatgaagtaaaaatccatttccaggatggccgcatgaaatggtcccatttggctgcctcatcccgtggtgccttggcctgagtaggggtaagtgaacagttcaggggaaacctgaatcagttcaaatctaaatctccttaaaaatgcaggaagaaaaaagtctcttagttttctcaactgaacctttgttgttgtttattcagcaacagtaaaaacaatttgtttatatatagttcctattaggtgttgagtgacattcctcatgtcagaggaacaaaggtggatggccaacactccctgccctggaggagcttagagtctgttgaggaaagacagattcagcaacaactaagtgtggtatggcctgagtgtcaccaccaatagggtgaaattattttggaagcaaagagagggagccactaactgctttttcacttcagtgtttgatctttctttagttctagaaagaaacttttttttctgtttctgttctcatttagtagatgcttctctcctcatattctgtgtcagctattaatagtaagatggtgtattcatttgctaggactgctataacaaagtaccatggatggggtggcttaactatatttcctcacatttctggaggctagaagtctaagagcaaggtgtcagcaaggttggtctctccccaactttttttttgagacggagtctcgctctgtcacccagactcgaatgcagtggtgcgatcttggctcactgcaacctctgcctcctgggttcaagcaattttcctgcctcagcctcctgagtagctggga

SEQ ID NO: 136696 - DNA, 1062 bp, Homo sapiens
tgtttcctaacatgccacccagaagaactaggctgccccttttaaggtacttcatagtttcctattgtcctttcacgtgtgtaacacgagttctcacagtactcctgtgaggcagcagtggattgtgctcattatattgatgaagaaattaaagttactaaagttccttgacatttgcagatttaacgcttgtcgcttgaactctttgcaagtgatactgaaggtaggtaacatgttagtgtgtgttattttgctgatgccagatttaaattgaactgaaagaatatccagtcacttaactaatgagcaagccaagcctactgctcctcacccacactgccacggggtcctgttctgtgttccccatcagctaagtagttacactcatgaagtgctaatagttatattactttgtggaaaatggtctccaaaacaaagacaacagctagtactgaaaagggtcttaaaaggtagtattttttaagccagaaaataagagttttatagaagaaattatatgctttagtgtatatgggaatgtggagattttggaaagtctcaagatgggtcccatttcagtgttaaggatttccgctatatttcctgaactgttaaagtgaaagcaggaaagtttcatcatgaaagtagcaaagagcccctgtggtcctctctaagctagttgacatccttagaatttacttggttaaatccttaacaaaatattaaaaagaagactgtgtcagagagcacctgtctggtccttttcttcttattgccactttttgaagcccactggttgtgttctgttttttggtttttttttgagacggagtctcactctgtcgcccaggctagagtgcagtggtgtgatcttggctcactacaagctctgcctcctgggttcacgccattctcctgcctcagcctcccgagtagctgggactacaggcatctgccaccacgcccggctaattttttgtgtttttagtagagatggggtttcaccgcgttagtcaggatggtcttgatctcctgaccttgtgatccacccgcctcggcctc

SEQ ID NO: 136697 - DNA, 1109 bp, Homo sapiens
actagaatttgttatagttatctctaggtggattatagcttttctttttctttataattttatatattttctacattatgtactctgagcatgtactgctctcataacatgaaaaaaattataagcactaaaatgttatagagaatgttactcaacttgaagtaattacccaaataatttcacaattgagggaaaaaataacatagaaatgaacccaaaccagctttttttctccgtgtatttttttccaagtcaaacctaaggccttgttactccaagtgtgatcagtaacccagcagcataggcatcacgtggaagcttgttagaaatgcacaatatcagacccacccctgacctactgcatcagcatctgcattttaacaagatcctcaggtgattcctccgcgtgttaaagtttcagaagcactgatctaagacactctcccttaataactaaagcctacttctattttattcattcattgattagggccgtccttttggtaaaactttaaaacaacaactatgcaggctacagaaggactacccaagttttaaggtagaattcatatcacaacctggccttttgaaatatgtttttattaagctaaaaatgcagtggtctgacaagggctaagagaggggaaaaaagccaaaaagcatgagttcttccactttgtttcttcgtaactagaaggaacaagggagaagtaaattaggattttcaaaatagctttcagctttttaagattagtggcttataaaagaaagaactaaggccgggcacagtggctcacgcctgtaatcccagcactttgggagcactttggcaggtggatcacctgaggccaggagtttgagaccagcctgatcaacatggtgaaacctccgtctctattaaaagtaaaaaaattagccaggcatggtggcacgtgcctgtaatcccagctacttgggaggctgaggcaggagaatcgcttgaaccctggaggtggaggttgcagtgagccgagatcgcaccatagcactccagcctgggccacagagtgagactccatctcaataaaaaaagaactggagtgtagttctacacccacttcgtgtaaggg

SEQ ID NO: 136698 - DNA, 1069 bp, Homo sapiens
cagcaacacaagggctctgccatgtctaggtgataatgtggttgatggtctgcatttgcaaagcatattgtcattttttagtaggaaaaatactaaagattgataagtttttttatgtacttcttaaaaatatgcttctatcaccaatgatgaaaaaaatgaaacaattcgcaagcagttaagccataatgtgagctaatcactttattttgaagaaaagtatttttaaacagttgagctagtgaatttacttttaaaatgtattgtgcttacacagtagatggttttatttccatgatgttttttactacataattatacatcttaattacgtaattactatcataattattatgtaattgcatgtacttccactaattacaaaatcaggaagtgtaattatctagtaaaaactttatgaaatttcatgcactaaaagttagttaaaaggctattccagtggtctagtggaaggctttccatggttagtcttcttagtcataactttagtttagagctggaactcataggccaggacaaggataagtgccaacagaccaacactaaactgagtattgtggtatgggtaagatagactttgtcccttgtgatttaaaaagtcagagagcattttaatttttttgtgactatggagtgtggtaagaataatatctaaatgtttgaggtaggtaccacaaaaactgtcaatggaaagggcagttctttcttaggaaggaattgattaatagaatcaacaaggcatttaggttacacaacagcaaggtcttctataattctgtaatgtgaatggcttatttaatagctatctctgcctttaaaagcaataatgatattcagttttctgtttcttcagtttggagaaggtgtttttccagtttgtgtttatatttactaagatatgagcaaacgtatcaagagagcatactcctttctactacttgatgtcaaaagcagcttttgagacataaacataagcgcacaaacatgtaacatcagaccctaaataaagacaaaaggtttaattcaataaagctatgatgcctttacc

SEQ ID NO: 136699 - DNA, 1034 bp, Homo sapiens
cctacttaaaaaaaatatctctatagtgcatggtgcgccaggttaaccactcctgtttgttagtctgtatacagctcaacaaataagcggcaaagcttttcatgggtatatagtggctttccattgaggttttcactctttgaaggaggtcatttataccaatgagatctgtagatgcaaattgctttccctatatgtgaggggtcattcctttcacagccagcttgctcatctcttttataaaggttttgttatttttgtactgctcccaaaggaatgatgagaattatgcccccccaccccctgtctaacttagcatccaaatcttttccctccagctctgtgaaacttttgtgtgttgatctttggaaacaaaacaagctgttggcagcagcctttaactctgaatcaggaaacttttttccttctttcaacctgaaatatcatctctttagatttgcctttctcgcctaattctaaggaaatatctttttcattgcagcagagtgtcactgtaacatgctacaggcatgtgggaattcctggaagcagtgtcctcaaaatgccatttttagtttggctcaaatgatgtaagctctcacgaactagaggaatagaaatgaagggatcgatttaagggttagctatgaaaacctagcttctgatctcattactgaagtaaagggaaagataatatttgtctttgcctaggctctaaggaatcatacaaacattcaacggttctagtttgttgtgttcaggagttttaggaaggaggagcttcaggcataccatgtgaatgctctgtaaaatgtttgttgttttgttccttccttctgctagcatttgttgaacaccaagggcattggcctgggtttctcaaaagcaatatagggtagtgattaaaaactcagtctctggagtgagagtgccaggtgcaaattttgactttccaccccttactagataagtaaccttgaagtacatctataaaacaggaaaaaaatagcacctacctcaaagggttctaaatt

SEQ ID NO: 136700 - DNA, 1080 bp, Homo sapiens
tgcattggcgcaatcacggctcactgcagccttgactccccaggttcaggtgaccctcccacttaagcctcccaagtagctgtgactacaggcatgtgccaccatgcctggctaattttttgtattttttttttagagacaaggttttgccatgttgctcaagttggtctgcaactcctgaactgaagagatccgcctgccttggcctcccaaagtgttgggattacaggcaggagccaccgcatccagccacctgcagatttttctagtgattcacagttttagctctctgctccagatgtgttatttggttggctagcctttaatatatcttgaaatgtctggaggccaactccagaaagctctcgtgaaggtgggaaggtgaagaaccgctaagagactttcagactggttttctcttatcacccatgtgactttcagttgagcagcatgcaggcacacgtattaatggcaatgtaggtttgtaaacaatactactaataggctggggctgggggagaaaaatagcccacaagaaatctggagatacctgtcttgagtgtaacctgcaagatatactctaacagagtaatcattgcacgatatcattgtgggagactgagcgagttagaaaatctattcctggtttgtcgctgactcactttgtggcatgggcaaaccattattactctttgatttagttgttttatttgttcgaaaaagggaaaataacatgtgtttaaaaagcactctgaaattcctctgaaaggaggtctataagtgcaaagtactattgttgtttttattattattattagtgttctagtatggtttagttttatgccatgtaggtcacagatgtttcaattcttccgactgatgaattacaaaacacttccatctcattctgttttatagcgttgataacagtttagcacatctttgttttaaccccagttaaagtatatgtccaaaatagacctcattaataaaatacaattactaaattaaatatatctatgctactttctgtttttttttttcctccttaaaaaggtggttaccaacaactactaaata

SEQ ID NO: 136701 - DNA, 1012 bp, Homo sapiens
accaaatgtgcacctgctggaagcactctgtgtattttctctagaaattatgtacggaggtctagaggaaaatgctaaagccttaaaaattacatattaattagggagattctgaagagcatcacaactttcaaaggtgactgggataatgcagtcttattcccatatcagcatgttgtttcttgtgtgctctgctaagcagctgctagagtcctaaagacctctagtatgacagtgagtacatttgtgagttgtgttgccccaaattatagtagggatggggataaagaaatatgtttgtatacaaattcttgctagatactaataaccagtgctggagaaccttccacattagttccaggaagtgcactgtaaagacctgttggttttagttttctcttggtacatttgaaatatgtcactggcttttaaaattaaatatgctttttatgcttttaagtattgtctcttttgaacttttgagtgtgagggttgaatttttagtgagaaaagaattttgtttggatttgtttttaattagtattttttaaaaaatatgttaagggcttctggtggtggtggaaaatattaattcctttaaaaatctggctgtgttgctagatccacatttgcttttctgtgtttttgtgaacaactgatcaaattagattcgtcactcttggcttacggtgatttgaaattgaaatggaatatattaaagcagccaaccacactgattacattgcaagcctcatttaatttcatacattcacactttacagtgaaaggcagcttttttaatgcatgattgtgactgtaccttgagcaactccaaaggtcatctgtaatgggtgcataatttgttagtgttagatatctgatttatggtaggtgtttctcagcctgatttgtactagtagtaaatatggtgagcatcaaagtaaaatctgtaagaagtttagcctgtcacatttggtggtattgtcttattcttcactggtcagtggaccac

SEQ ID NO: 136702 - DNA, 1593 bp, Homo sapiens
aagtttgttttaatgatttagaaaatatcctagtattcattattataaagtgtttattttgcagagttttcatttgaaaaactagcaactctgccttaccatagaaatgcatcgttcttcaagtttttgaaaacattttggttctacatattagactttaactcttgaatgctagccctgcctagtaataaaacatgttttttttccagtgccacttaatggcaagtctcttcaagtttctcaacagtcaactgctgtaaatgtacctgaggtacattctcattttctagagggggaacaggaaaaattccactgccaccatccacccctgtcatccaaaagcaagtttattagtgaacttcaagtcagcattctaaccctactatctggtctctcttttttacttttttatccttttgggtttatcaagtccttattttaagattaacatgaagaatacttaatgttgtaaaggctacatggatggttttgacatcagagtgacaaaatatgttttaaaaggataacaatatctgagtgcatgtttgtaagagcagctagataacatggcaaactctgacagcaatcatttcttcactcctgccccatttttcctaagcaaatacacttagggtgctcttcagtggtagtgtatataaaggatggtctccaaaaagagattggcagctttaatttgtttgatatgtgcaatcatggtccgtgttaaattcaaaatgcttgtccaatcaaggattcaatatagaaaagaggcagtaacaagcatgctgcacactgtaataaagaaatctgttgattgaaaacagtttgtatattttggaaatgatagggaatgtaattggtaagaaagaaaaggatagggcttcataaataatgggaaatagagcatattttttactgataatactaactcaatttaataacattttggtgttgaatttttgtgtgccagaaaataagaaagatgggttcttttttgttactctaaatgtcatgattcatgggttgaccttttttgtttttgtgtccatcgagagcagctttgacaggttgaatcaggcaatagtgggtgatacgttccggttctttgagaactttcacagaacatttttcttttgttctctcatccaagaagacgaaacatatttttaactgttttttttttttttaggtacaagtactacatgaatgcatttctgtggtaaaagatctaaacaatagagaaatatacagagcaaagtctgtatacttttcgtacatagatgtctgggtagagatttgtatgctgattgtttgaggggctgtagtattaagaaattgaggctgggcgcagtggctcacgcttgtaatcccagcactttgggaggctgaggtgggcagatggcttgagctcaggagttcgagaccagcctgggtaacatggcgaaacccattttatacaaaatttagccagttgcagtcgtgcatgcctgtagtcccagctacttgtgggactgcaacaggaggatcgcttgaacctgggaggttgaggccatagtgaaccgagactgcaccactgcactccagcctggggga

SEQ ID NO: 136703 - DNA, 1629 bp, Homo sapiens
catgttaagaaacatcttctggctgggtgcagtggctcatgcctataatcacagcactttgggaggccaaggcttgcagattgcctgagttcaggagttcgagaccagccatggccaacatggtgaaaccccgtctctactaaaaatacaaaaaattagctgggtgtggtggcacttgcctgtaatcctagctactacttgggaggctgaggcaggagaatcttgaacttgaacccaggaggcggggtttgcagtgagctgagatagcgccactgcactccagcctgggtgacaagagcaaaactgtctcaaaaaaaaagaaaaggcaagaaagaaaaagaaagagagagagagaaagaaaggaaaagaaaaaagaaagtcctccaatgtttgtgcctaggcctgaacctcctagattgtctccactggcttcaggctgtgtccactctaaaacatctctagccttcagggtcctatcttggcctttgtcatggcatgtctccagagggttctccctcttcccagggttacctgagtatacagcctgcagtaacctgctctttctctaggtgcttccattcacctgaaatgtagttattctccaaaggcaggctctctttggttattctgaactgggctctccataatccctcccctcccaccatggtcgggagtcttcctgggagccactgactttctttggcgaccatctacattgtattggttgctgcggacaaccaaaagcaaacctgtatgtactgttttcctagttgggtacccacccccacacaagcttccctttcttgggggatgtgtctagttctcagcccattttcagaacagaaatgtcgtgaatttagtatttgaccagttttttttttccccctaggcccagattctcttgagtagctcattgttcatacttgttttctttttcccattaaatcacctacccaggagagtattttgttttctaaaaaatagtcacttatcaattaaatgacaggaaaaaaaaaatccaccccagagaggagacctagtatttattggacacatgggaaaaatgagcctttctaacagagggatggtcatcttgtacaagtacactgagggcagctgttctcaaccaggatgattttgcctccccacccgagggaacatttgacaatgtctggagacatttcattgtcacaagttggggagaagcaggagggaggctgctgctggcgtctagtgggtagaggccaaggctgctactaaacttctacagtggacacaagatagacccacaaataatgattggcaccaaatgttagtaggttaagatagcaaagacttggaatcaacccaaatgcccatcaataatagactggataaagaaaatgtgacacatatacaccatggaataccatgcagccataaaaaaagaatgagttcatgtactttgcagggacatggatgaagctggaaaccatcatcctcagcaaactaacacaggaacagaaaaccaaacactgcatgttctcactcataagtgggagttgaacagtgagaacacatggtcacaggaatgggaacatcacacaccggggcatgttggggggtggggggcaaggggagagagagcat

SEQ ID NO: 136704 - DNA, 1083 bp, Homo sapiens
cacccggcccttgggtggctactttcatagaaaggcagctatgctatattgatatggaacagaggcttatttattaaataaattcactttagcaataataaactcattacatgttaacatagaaaccttttatgaaaatagctatatctttcaaaacaaaaaaaaaaaatggtgagaagagcagcattgttttaaattttggcaaatctctttattctctggcttaatagaaagccagcctgatttctcatctgcttctgcattcaatctgtggtaacatcacacatcatgtagcctctggaaactccactgtagacccatgagagaatgagagtggaaaaagccagtaatgtcttcgtatgatttcgaaaaaagttttgaccttgaagacccctaaaagggtcactccagatgtcccctggcccacacattgtaaactgctgctctagaactgtgagatctgtgaagcagaatggggaaaaagtcacatgtttaatttcactactctttaactagaatttagcgcacccttcaaatatggatggaggcctcagaatacagtggtattagcagtatctgactttgttatcagcagtagacgtcaaggatgttttctgatcacattacagttgttgcagatatctaaaatatcacttagcattgctttgaaattttactcaccacagtgctagatcttgtctataatgccttaataagaaagtacatacactactataccacaggtgtgttctttaataccgacaagtatatttcagtgtaattgctttactttgcactcctatgttgttttatttgttttacctatttaaaaacattctgagataggagctgtgggctttagttgactgccaaaggagtcctcggtacaaaaaaccttcagaagccttactctagaaagttacacagccagaaaggcatgccttggccattttgggaaagcagtacagccccaaagcaagctcaaatcggagtgtttgaagaaagcaagttccattgccactgttgtcggcctgtgtcctgcccacctctgtatgcacagccacaacttcaagtaattacaat

SEQ ID NO: 136705 - DNA, 1088 bp, Homo sapiens
ttatcagaagttcatatgtctggttacaaaaagcagtccctttccttcccatttcccagtcttcaaacacaaccacttgggactccttccactgctgttttcagtattcacctccttatctctaaataataggcacagagtgcatctcccagtaatctcctacaatgagaaaagaggccttaacacctccagccatggtcctcaggcagttagagcatgattccggcagactgattgattgataccaatagccactattgatacataccaattcttcctctgcttttctaaacctgctcttaaatcagttcacacataactggtatctgagctgatgaccctcgcggcctgatgcacagctgttatcctgggaatcttcctttaccatcatctgggtattgccttcacatatcacttatttcagagtccctgtgccctacagtctgtatctttgtttactgtccctcttttggggagaggtaaaacatctcttccagtagcttcctgagaaagagtacttggcagatgaagcttttgagacctttcttgtcttaaaatgtccttaattcaccctcatacttaattgatagttagatacagaattctaggctggaactcagtgttcctcataattttgaaaacattgttctactgtcatcttttttagtgttgcttttgaaaagttgaaagcttttctgagtcctaatcctttatatatttgacctgtgtcctttttttttctccttccttgttagacacttggaggatttcctttgcacccagtgcatgggcacattcatgatggtgtgttttggtctggggcagttttcatttatggtgctgggtacttggtgggctctttccatttggaaagtcaagccctccagttctgggaagttttcttgaatttcttctttgatttccttcctaccatgtccaattatgttttaatttctaagaactagaattttcttgtttttgcagtgttcctgttctcatggatgtgatctgtcaataacttgagatctcttcttgtgtgctggtcagattccccagaatagatccagtctcctccctgaagaggatta

SEQ ID NO: 136706 - DNA, 3031 bp, Homo sapiens
taatggatcggttgtcataacttcaccaacttacagctctttttttccacataaaacttgccaaaatgccttcagactgaagggagaaaaaatttaactgtttccttcaaattaaattttattagcagagaactagtattaagatcattgcatgaagaaaatgtaaattagccgcttactgtaaaatagtattagagaaggcaagtgataaacatgtctattcctctttttccctttattagtggttaataatcaataaatagcagcttaatgattaacattataaaagattacataagagttttagaagaatttagattttctttactaggtagtcatcttcatttttataaaactgacatcagtgttaagccatttttaccacaggttaaaatttgactgacctattctgttgctgactgagtcataccaggtcactgaaacctaaaataagtatgttgtaagcatcgcgtaacaattataacctatttagatccaagatccacttaagacatgttgacttcttttctgcatcactgagatggccgacacatccatcaataatgtgctgaagttctcattagctctctatacagggaaggatgccagcaaaatgtacagaagtaaattcactggaatctctggtcagaaattatgactgttctatatgtcagcccatgtgttgctaacagatttttttctttacaaaaatgtgttttgtggtttgatttgacccatggttcatctgaatccaggcaattacacttatattaagggttctactgtccactttctcctcatcttgagaaatgtcaaaaggcacatatcctgcatctgaaggaaacacaagaaacaaaaatggaaatgcctgaagagtgctttcacctgcattaatcaagggacagctgctgccattcccaaggcgctgccctgcagttggctgagcagacccacatgggcctgctgaattaagtctgaattaagagtcagactgcgagtgatgctgcctctgtgtttaggtgaaaaggccactttagcaagtgtaataaaatgtatagactcaggtgagactccaggggaaattttgccccttgagtttgggttggagaaatgacctccagatctctaatatcattcactgtggaggagatgtggaccatgtattttttccttttcttccctttataagatggtaatttccccttagggatttgggtttctctgttgtatgcattaatagggagatgggggagagagagagagagtcacaaattaaagtcattttatggtaagtgtctatgccttttcacctctatgcttcactttgtagaactcgtcaggaaaatcattcaggtgacgactatgcattttgatgttaacagatccgactcttaccgggtagacgaccagttaacaacatgaaataaggcagtgatggtttttgaaatgaaataatgtttgatgtaacctcgagtttctctctgaactctgaccacactgtagaaacccctaggaggaggtgagcagctctgtcaggcacagaattacacccagggaagaaaaattaattccaatactaagggagaaggctgtgttctcttgcatgatatttagcagcaagagcaaggagagggatgtttccttctttgtgtaatgtgcagtagttacaataaacacaagatttccaaatctcagaggactcttcttgacagttgcttgataacagcttttttcattccatagttttgacagtttgtgtgtgttgccatatctagtgtaaactaaaacatcactgtcattctgtttttcttttgtatgtggctttttttttttcatctttaggataatgaaaaagatgggcttttcacttgtagactagagtaaggcaagttgtgtgtggagattagcatgtgtttataagttttgaaagattcaagttgacagcagaacactgctttaaataatttttttctccatatcgcttcagtaaaagtacaagtgggatgtgtaagttttctcttaatcttttgataaatagcaaaccttaggcatctgtgtgggtacctatattatttatcggtggttattgaaaatgaatgactacaatgaacatctctagagctcctggctgtgtagcctttgataagtggtgagcatcctgtatcttactgttaccagggtcttgccctgccccacgtaggtgcttttcagtccctcgctatgcttcccttcacttgatggatcccctatcccacccacctctgtcaggtttatagctatgctacgttattggtttgtgtccaaaccaacaggatgatattgttgttgtggttgatgatttatctggagtaactctagaaactacattgcatctgcactgtttgagaggctgcagggcaggtgatgggccagaagcccaagtcaggatcagagcagtctttactcatcagatgtgaactctcagattccccaaagtcaggaagggatcccatacctgagagaccttcccccctccagccccaataacctttgatttgtagaagtctcagtgaggttattttgccatcaaaccaaatttgctgtagcatagcaaagctcccaatgccgtcatctggcatgttacagacaaattccaattacttttctacttcgagctattgttaaacactacaagctagctgacagtaaaattataaatacaggtgttgtcacactacactataatcagaattttaatttgaattttcatttgtaaagcctttttttcagatgaaaatgggaatagaattagttttattgacagtaaaaagacattttgaaagcttcctaaatcattacctgtatttagcaggaggaaaaattgtatatgtccatgtaaaaagaagagttttattatcacatatttactcattatatttggtggtaaataaaacggggaagacatgtttgacaaatgattgacggaactcactaggtttttgcttcatcagaacaatagacagacataaatatatattttgcttttgttttg

SEQ ID NO: 136707 - DNA, 1681 bp, Homo sapiens
tctcaagtccctcccctccctccactggctttgcttgtgaatgaaagggactcctactatgactaaggacagatggcagctgtatacgttgtatttgatgtattttggagtgagccatattttaaaattcagggccaatagatgggctattttgagagtggcactagcgccatcctttaagcctgctccatttcctccaaatttatttacattttaaaaattatataaataagctataatctgtgctcaaaataattgagttgtgatcttttaactgtattgcattaataataaaagcaactcagacttctgggctgcctttcttctaaagagtatgtgttcatttatctttatgttgtctctaatggatttttctcgtttatgttaatcatatctctagtattatcagattctgatcctaatgaaggcaggcacttttgtctgttttgtccattcctatgtcccagggcttagaatagtatctggcacgtagtaggcactcagtaaatatttgctgaatgaattaataattcatgtttctatgggtacatcgaattgtagtgtatttacttatttgtatgttttcctctccagctagaatgccaaactgtgctcctgaaatacagcaggcgtgctaaggcattttggaatcctttcttcatctctaccctatcccaaattgtacatgacacccagtcagtacttaataaatatttgtcaaataaacaagtagagaagcccaaacgcaatttatttgccagtgaaagatatggtcatttggtggtagagatgaggataggttaatggcccatcaatcagtattgttaagagtctccacgttcttagccttatgttaattcagagttctttcccaggtatcctattggttttctgggcttattgccaagcatattttagatccatattttccttcagtttacagtttaagagcattttaatttttgctaaagcttgcaaaaaaaggctctgataatgatgcagtcaatatcagtaaccatcccatttgctagtgccatctagatgaatccattgtgtagatcgtcctgtcttaatatgggagggagactgctgtgcatggtgggatggcctatagcagttagacctctctaagcaccatttgcctcttctgtggaattgtggtttagtcattctgtcgtgtcctctactacctgcctcccccaaaactccctgcttccgtctgcaaaatgaggacctagaggctgcttaacaaggccagaggcttcagagaattcagtgacttaatcaagaactgtactgtgtaagagacacactgctttccctttaaatcattgagtgtaagagacacaccgctttcccttttaatcattgagtcataaatgtgacatagctttaaatggatagcaacaatttgcaaatcaataagacccattttgtaattagctttggactaagcattaaaaagtatacattgaggattatggtagttaaaatgctgagcagtgtggggattcttccttggtagctgaaactgtgcataataaacatacagaaatgaggatggcgagtttcagttttaccacaaggttatgcatttatttgagaagaatctgagatgtgcaatacaacattccctaatatgctcatttcatcttctctgctatcattgaaccttcatcta

SEQ ID NO: 136708 - DNA, 1060 bp, Homo sapiens
ggaatagcagtccacatgaagagaacttggaaatgatccttgccccgttgagcactcaggagacagtgggactgacaccttgattgtagccttgtgagaaaccttgagccagagatgcccagctcagccatgcttggattcctgtcccacagaaaccgagaaatgtatgtattgtgtgttatgtttagccatcaaatcatggggtgatttgttacacagcaatggtccactaataaaccctttaaagtgcaatgcttatttaagcttctgtttctcataacctgtttgacagtgccttgcatgtagcaggttatccacagatacttgtttactgatccgcttacactaaatgtatagtcatatgtttcattattattttgccagaatactgatttggcttaatcaaaaatgttcatctttttctccacaaggtatgtaactcaccatcttgaggtatggcatctgtggatccatgatacccaagcaggaagggaatgttccctacccgcaaacaaatacggaacccaagaaaggctgagtgcccctggaatcgttgtaactttatccttccccagtgtgcagaagggaaagggtgttacgagaatcttgccttcatgtcaggatttaggaaggcacgacctcttttctacactctatccagaatgtgatggtgacctggaatggtaagggccccaccaagaagacctgtttatagcacagctgttaccttcaccatccaactgtggcctcgctttagttccagctgtttatattagtcaaaactgtccctaacaccacagcataggctgtgagaacaagaggctagtgagaagggaagatatccagaggattaagaagcaaccaagccatggcctatgttcttttgactttatccccaaaagaacaacagcttagctgatggtacagcctttggcccaagaaatgtaaaagccattccttcaggtgcctatttgcatatttctacaccctgagggcttttttcttctcccacctgtggtaaatgactgtgtacactggactgtatttactgcctatctgt

SEQ ID NO: 136709 - DNA, 1015 bp, Homo sapiens
ataaacttcccaggattcgacttgactctgtcccaaccccctaacccccctgagcaccactgacctgggactgatcatctccttgtctgtcatggaatattaattggacattaagatttttagattttttttttttttgagacagggtcttactctgttgcccaggctggagtgcggtggcacaatcacagctcactgcagcctctaccttctgggcccatctcccacctcagcctcccatgtagctgggaccacaggcatgcgccaccattcctagctaatgaagatactcagaatgcttccattttctcatgacttcatgtgtattaaaaagtagtgcttacatcaaatttcactgtagtcactatcccattggctttgattaaattacaagcttctgtgtagaatgccgtgaaaggtttttgcgaattgcagtaatagccatggggggtgggggtgggtgatgaacatgttttctgctggggtagtaactcagaactctaggcctttggtacagttgatccttaataagacttagtttcaggttggaaactgtttgttgaaggtcaacattttgttgctgctttttctgctcaaatgtagtatagaatcatgtggaggataaaattttgctagttgttcagcgtatccagaacagagttctggcagttaaggcgtacaatactcttgtatacctcaatgatggcgctttttaaacattagggtagttttaaaaaattgcaataaagtcattgtaattcatagaccatgctgtaatacagagatacgtgtaaaatacaatctgtgtacctgattgcaggtaacagagttaaatgtaccagcaatttcaaacacagtttgatatttcctataataaaatataatgtaaaaaattaaatatccaatatcaatggattctaaatggttttgatatttctttttgtcctttcccatgaagagtaatttatttccctttttaaagtgtgggcagaatgattactagcgcactgtaatg

SEQ ID NO: 136710 - DNA, 1034 bp, Homo sapiens
catgtagaaaggatcagagtaaataagctttatatacacgttcctcgaatgttattctcaagaaaagtttaaaaaggagattagctttgctgatgtattaagatgagtgatttctgggtgatacttcaagccattagagtatatttcagtgacgcacttgtgtgtaggaagagcatttcctccccgatctcgacaaaggttggctttgtggtgctggtggcggagacagcagttaccagggccagtggcatctctgtggacagggatgggatggctgcggatcttctctggctcttgcctaatggcatgttggaatcttttaacagttgttattgggcacctgacctgcagcacctgaggtgatggcgtcgttactgataggctgactctcaaaatcaaagcaggaaaaggaatcagggttttactggccacattaactggcctccaccagttaacacctgtattttcccttgagttctaaagtggtggatatagtattgacagaaacagggtaacagtttaatgtgaggcctaacgtgggtggcccaggtgcctaaagggggaagagaaaaaccaggaaggggtgactccttccccccaccagcccctgtccctgacgcagcctgtgacagctagtccagttctgtttcctagaagaccttccatatgttattgattaaattctctttggggaagcaagtgggagcttttatctgcatctctaactggcgtggaatggtgccttggccgtattgactggctatgggatatgctggcggtcacagttgtcttttaggaggaagagcaccgagtgacgctggttgtcattctaactctgctgtgtggcagcgtaaatagtcccctttctaaccaacctggtgggaaaagtcaatatcccatcagcagaggaggtaaacacatcaggagctatgtcctctcttttcctcccctgctccgtattaccgcagctctttaaatgtgctctccccagtcatcagatgcatttgtgtcattcacatgcacggggttgctgg

SEQ ID NO: 136711 - DNA, 1580 bp, Homo sapiens
tccaccccttttgggcattttaattctctataaaacctgtggttgttctttaaaggacaacttatgtaattcagaaaaggttgtggagagcaaatgcgaatgtatagccaagaaacaaaaatctggagtctgagttttcgttttccgggtgttttgtagacttcccgtgttgctgttgttggaggtttgctttctgtgagtggcgcgctctcccctccgtgtttccttcctgaccggttcctatcgggaggtgctgggcagccttgctgctcccaggccctttggcacaggccagcatcttatgggggcggaggcctcacctcaggatcagctgatgtctgaggcctgcaaatttctatgtgggagtagtgatgtagtggcagggggagtgggcagaagtgagcctctcctcaggtgcgggctgggggttctggctacctgggtttgcgtgtctacaactctgattacctgctgtgtaaccttgggtaagtgacttaacctcccagtttcctcagccatcaaatggggattgggggtggggggggcgcggggaaagcagcctctccagacaccttaccaggttcctgaacacagcgtcatcccccacgtgatcactctcttcacccaaaagatcagacctgagcatcacagccccactgctcctttaaaagaacaacatgtagggccgggcgcagtggctcacgcctggaatcccagcactttgggaggccaaggcaggagaatcacttgaacccgggaggcggaggttgcggtgagccgagatcgcgccactgcactccagactgggcaacaagagcaaacctctgtctcaaaaaaaaaaaaagaaagaaaaaaaacaacatgtagaagtagcaggctctgggaagggaaaggagaggggtcttttctctggctggtagcatcctgctcagaagggaaaggccagggatgaatgggttaaaggagcaggagtgccgcataccctgagttcacacagtgtggacaaagaagagcaaagaaatcttggccatggacagacaggtgccctcggggccgctcacctctcgcctctttcagcaaaggaaattttgtttagcagagggacttgggctggagggactagaaaatgcttactaggcccagctgatctggggagttggggctggaaggcaccagaggccatagctccctttgagactaggtgtttcctgccacgtccagacttcgcaagcagttgcatgcatgtgctcgcagcgccggtgaaagtggcgtctgcgagtagagctcaccttgtctgctgcacatgagggtgcacctgcagttcacatcagtagagggtggccctgtcccccagtgcactgagtcagctaggtgctgagaggcggacagacaggggaaaggaagaaaagctttcacagaggaatggtcggcgggggctgcatctgactggccccaggggtagaccagagataagatggtggagatacaaatggaatcagcatccccttctctggtggaatactgaatgttctttaaagaaactacctgagacttctaatctctctctctctctttttaga

SEQ ID NO: 136712 - DNA, 1060 bp, Homo sapiens
agccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaagcagttgtggtgaatccttaccaggtgcaaagagttgactagagaggcagcaaggagtaaaatgtgagtagagccagttgctgtggcacacacctgtagtcctggctactcgggaggtggaggcaggaggatggcttgagcccaggagttcaaagcagactgggcaacatagtgaggcccccacctctaaatacatacacacgtacatacatatacatatacatatacatatacatatacatatacatacacacacacatatatatatatacacacacatatatatacacatatatatatatatgactagaggccatccccttttcaaacctcagcccagtttcttcatagccacctctatcagaacccagctcaggagtgcacagcatgatatttggtcgaatgttctgagaagcattcagaatttctgtgactttaggtcatttaagagatgaagtatggtttcttacgtgctttgctgacttagagag

SEQ ID NO: 136713 - DNA, 1131 bp, Homo sapiens
gagatttcatacctcagagtagacttctcatgattttttttagttctttctgagatttgcagctaaaatgtttctcacttttacttatgcctgaattccactgcatttgttataccttccatttatttcataaattagggtttaaccggctcatagatcaaataatgaaaaatgaaaattcaatttgcatcttcatttctaattccccttgttgctcttagatggttataaaagataaaaagaaagaatactgccattactccaccaccttcaaatcacaatttcaatttattacagtttgcaataatatactaaaatcttatttgcttgttacatggattttagaaaataactattgatactctattacataagaggaggtgataactatccttacagaatctctacctctcccacccccacttctacctttcattaagaatacttagttacagagcatataaatatgaaaattaatatatgccttgatattcaaaaataattgaatatatgagataatattgatgatggaggtagagggtgggaaaggtagggtgttttcttttttctctgagtatgtgagtggagggagggaggcacaaagcaaggaaggaaagatggaaggaagaaaggaagtaagggaggaagtagggaagtaaggaaaggaggaaataaggaaaggagggagggagggagaaaagaaagaagaaacttttatgtatcattataatagataatcttgtttctgtggctgatttctgccacagaccttcagtgacacccaagggagctgtggaattgaatacaagtgcctcttgtagagaactaagcagaggctgccactccatcctgtcattgctttagcagtgctccgccacctcaattctggcctctttggctatcagctcttgtttttcacaaccctgggaggtagtggcaagttcatgtgggctacagttgtaccaaaatgatccctgcaagagtgatgcatctagctccaactgccatgtttctgatcaattctcacttatgactttccaactgtaggtcttaaaagatacataaaaagtcctttaatgatacccaattctttactttaatatttgagcatctatcatgcacaaggaacgt

SEQ ID NO: 136714 - DNA, 1004 bp, Homo sapiens
taaagtaccctggaaaggttttggtttactgtagtctttaaaaatccctccacaagaacatttccaaatactcactttgtagcacatcagctgtcaaatgatttgtaacttgggtgcctatgtctgaccaaaagtatatttagagttgttccattttaaggctttaaaatggtttattaatagggcagtacttccagctactcaaaccttgatttttattccagccctgagtcttaaatctgggcaagcacggcttctcagacatggtatcttctaagggcagtgattaagaggcaggacctgggagactactctgttgttgcatgctctattctcccctccacactgtaaaatcctcgcggataggagcaggatttcttttttttcctaactcccatagcacacacagagtgtattgaagaatgttcagcccaacctctttgcaagcatctttattacaaaagatgaagggagggtggatgtaatcaaatatgtactttatattggaaagcaaccaagcctctctgtgcatgcactaccctcatacaatcgataataaattagcattttatttatactgtataatgccgttcttttcaggagtctgatttggaagccaactactgtttgtgttctccaaagtggtttttgatggagtgctaattatgtttcacctcaagagcaatgctgacgggggaccacaatcgccttattgtagtagatccagctgatgaatctccaaggatagcctcatgctatattctggggggcaagtaaatataaaaatacatttttgatcaagaaaatgataccatttacacaacagtagcaggattcagcctttgtaaaacagctgcatagctgcataactgtgacgtgattttttttttttttagtagagaaaaaaacatggaggaaaatatatatcaactcaggaccctagctgaatctggggtttagtagttcatggtgggggcaggggactatattttcaaataaatcta

SEQ ID NO: 136715 - DNA, 3859 bp, Homo sapiens
gctggacacactgtcccacagagtgcaaccaaatcactggaggaacgtctccctggacagccaggcaccttgtcttgggtgtttctcactattagaatcatcttcaaccagcgtcctttcaaaatgattgaagtgggaacaaaattttccaggcaacttgagttgggatagtttttataatgctccttttgtatcttttttccctggtgctggaatctctgattaagtccctgccccctgcctagcatttttgagggtgcatagatcagtatttggtgggataataatttgttcaaacctcacgtttcatgacgtagagacctcagctcaccccagtgtctattatatgttacctttttgcttataccattgttttccaaacttgcctgtgcataagaagtacttgtgtgtgtgtggttgggggtgggagggagtagataaaagtctttctaggctcctgccttatatattctgattcagtagctctggcccagggtctgcaaatctgcattcataataagtgtcgcagatgattcttaagattatttggaaaacagtcttcttattccttcagccagtgttactaatcatccactatgttcctcgtcctgttgggatataaaggtgagaggggctcagcttccagaaatttacattccattagtttcagtatcaacagtttcccttgactctgttttatatacttttaacacacacacacacacacacacacacacacacacacacattcttccttattcttgattgacttttcctaatcctctctcaatatgagtttaaccagctaagctgagtgtgtttgaaacacaaatgtacctatatttgggagaaaggtaatgcctattaagagtgtggcctctctttgctgtttatcctttgtatgtcccatatataaatttaaatacattatatatataggttcaaacttaaggagatataaaactgtggagtccatttgcattttctcttccctgaccttattttgaaggccagtttgtgtgtctctgtgtgggggggaaccacttgggtggggagaaggtggaggggtatattgtgaacacagagaaaagtaatgtggcatacacaagatgaagttttcacaagccatgaatctagacctagagaagcttcagatttctggtggagtttcatgcaagcctcttcctactttcatcgatggaattcaaacacaacaaaattgggtcttaagcctggatctcaagctgtagatagaaggggatgataatgtgtggactagagtaatcagaactggaatatggattaaaatggttgctttatttttgttcttatttatgagatttgatattcgcccataataggagtgcctctcgcttattaccattattatttttttaaagaacactggttctgctgctctgtgatgattggcatggtgcttttaaaatacttttctgttgaattttttaggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaaactttcctgcatttatttctttcacttttacttcggtatcacactatactgcaaaaggtcatgtgttttctattacaaaagttattcttgaatcatggtacaattcgtgatgttttcatgtttactttttaaacttttaatgactataagaattttcaaaaacttcttactttaatatttttgaaaagagcctttttgaacactcattagaatcattcttttatttttttcaaaatcttccccaatacagaaatcatggtgcaatgagctaagtggccagtgttagctttcaaattattcgggcctctagactaatattggcctgcaggcaaataggtaaaatgaaactgtgcgtcaaagtttgtggctgtgaagtttaccaccattggctgaacgatcagtgtaatgatggaaagttcaaagaagaatggtaaaaacatttgtctcatggcaacacttcttgtttatcatggcttgtttctcataggtaaagtgcccacctcttgaaatatcatgaacttcttcatatttgcatagaaagtgaactggagtgatgattcattaaaccgtattctactgtcatattaaattgtgtgcgtttgttggctcatggccagtgtatttgcaaacgtgtgcatagaaacatagtaaatattaagtaagatcacatgatgtttcattcttggacacgttgcttctgaaaacgtagactggtttggccttttacccttttaaccgggaagctttgggtcttgtttaattgggatgaaacagaaatggctatttttaaaaagctagcaaaggactctgtggtgagctgttttataacaaagagatttttctccctccagacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattccagacagtcacaaatttctctgttccatagttaaagaagacatttgccaacaggtagcatagctctgtacatcttttaaaaaaaaaatagcagggtactagtataataagctattttcacaagtgtagcaatttcatggaacctgctcaaatcaaatttgtacatattgttataataaattttaaggtcttaactattaacttgattgaaaaaagcttcagcagggtttaagtaaggcctcaaaaactattaaaacctagccaacataagcaaaaagtatctttggaagtaacaacatgacattgaatgtaattatgtgccagtatcagtgggaggtcactttgctctatcttcatttccacttccctcagctgtatggaagactgcgtttgcatccaactggagtcaagaagcaatctgtaattataaagacatgcagaagtgaaagaggagattttctgttttattgggggatctttttggtacacagttatggatttaaagatccacaaggaacatacattctataatgaggggttatagttccagaaagctcaacatcattataaaaccactaattacacttcatcttttagatacattacgtttgtaactggtatattgaacaacatggcatgaaatcataaagcaactttattgttatctcctgctgcccctttaattataatccatagaactaatttttctttgtgtccagataaaatcaaggctactatatgtctatttgtttatgggcaataaattgcctgttattaatgagtgtatctagtctagggtaataacccattgcaggaagtcttaaactttctttcgtgcagatccctttggcagtctattgaatcctatggacattttctcaaaatcaggctctcagaggaatgcagtagggcggaagcaagcgtcatgatagtcacagcacacacacacacacacaca

SEQ ID NO: 136716 - DNA, 1578 bp, Homo sapiens
catgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggtaagggtactggccttaggcgccggcttttcccagctcacaaaagcatcgggcagtgcctatctaggggcgcgggcagtaacgagttttcagtgatcaggagagtgtcggggcaaaggtgaagaaatcgtgactaactcagcagagttggggtggggagctccaggaaccacttctgctgggtgggctgctatcagaaactcagccaagaggaggggagttgtttgtttaggtttgtacttggctctctacacatttcttaccatagaaaagtttgtgccttcatgggaaatggttattctttcttctttagctttcttttaagtccagagcatatctttttctaaaaaaagtttttgctcactgaagattctgcaacatcgatttctgaaaccccattctgaaatttactagaaccttttttggggggaggaaatctattaaggctagcaaaaaaggaaacatttgttaaagggtcccatagagagactattccctagggacacacaagacactagatgtagtgtttcatgggcctgcctctgaatggttatttgtatggtcctaagcatctggactatcccttcctccaaatctctgtgaataatatcaggttggcaaagggatagggaaaaaagacacattagggactgag

SEQ ID NO: 136717 - DNA, 1045 bp, Homo sapiens
caggagaatcacttggacccgggaggcggaggttgcagtgagcagagatcacaccactgcactccagcctgggcaatccagcctagccaacagagcgagactctgtctcaaaaaaataaaaataaataaaaaataaataaaagtaattgaaatgaatgcctgctgataaaagcccatgctttcaatggatatttgactaacttggcaagttgatgtaaatatttaatgattatttagctcttcactttaccgcaaatcatgttttcctgtgttatttagtatgtatatatctgtacatatatacacatatgtgtatatttatacataggcattatacatacaatgtatatattttttcaaagttctgtcagagctggcacttgactaaaaactgcatttgtgctttgatcctgacatatctttttttgtctaaagtgagaagctttcagtctaattttggtttgaatcttatttaatgacttaccctggtttgagctgccaagcatagttccactgtctcttgcactgtttatcttttgatcacccagggcaggtttcactttgtcttatattcatagaaatgtttatagagtaatcctgaatcataagaaagtttgcttaactggatttgattaatacataatatacacgatcatcatcttcccaacttaagaaagaccattaagacatgtgccaactaactgtgggttgatgtttaaagccatattcaagaattgcccacacaaatgcctgcagggaccaggcaggtagaagggggaaggcagactagagagatatccaggtcaaggggacagctagtagctgccaagcaggaacacaagcccagtgctgccagatcgtcagattaaaagcaggtagtctagagttttcaatgaaatctttcaattcttaaatgttggcaattagtttataaagcactgtgggggccaaaccaagcatggcagatgttctcaagtttatacagcctttgctcaatatgaaaatgggtaaaatatttcataactttgtaggcttcctttaggag

SEQ ID NO: 136718 - DNA, 1019 bp, Homo sapiens
agctgatgtgggcagggctggagctcgatgtgccccagctctctgtgcttccggggtctgtgtgtgctctttgcctctacatcacaccaagcatgacgttgtcaactacctttctggcccacacaaaagtctgagaacagattttttttttttctttcttctttttttttttttttttccgagacggagtctcgctctgttaccaggctggagtgcagtggcgtgatctcggctcactgcaccctccgcctcctgggttcaatcgattctcctgcctcagcctcctgagtagctgggattacaggtgcgtgccaccatgcctggcaaattttttgtgtttttagtagggacggggtttcactaggttggtcaggatggtcttgatctcttgacctcgtgatccgcccacctcggcctcccaaagtgctgggattataggcatgagccacagtgcccagcctggatctttttctttaagcttatgacctaaaatagaagcaactgatgactggatatctccacttctgtgcccaagcaacatctcaaacacacattatctaaaacaaaatttgcaatctcctatgcgttcctgtccggaagctactgctcctaccctatcccttgtctggtaaacactgcctactcagttgcactgacctgtaacttgtcatccctgggtgttgctctttttcctgcttgtacctcctgaattaagaatctctctgcacttgcacttcacttctgtcaatcccatcgcagcggccctcctagtggaggcctctgtatgtttcacctggactgcagacacattgcaactgctcttcctgtcccagtcttgcctccctctaatcctttctcatcaacaagtactgtgcaccctcgcccacctgaacaccctgcagtcctatgcccactgtcccgcatggactcccttctgttcaacctgaagtcttagtttagaagttaccacttctgagagcccttctcagaccctcataattctgggttacatgtccttt

SEQ ID NO: 136719 - DNA, 1048 bp, Homo sapiens
aaaaaagactagtatacttatttgacttttcagaattccttttgcttcccaaatatatcattctcaataataataaatatatttccatctacttagaaataatcagcgattagtgaaacatgcagataatttatcaaaattaattaaatctgcaggatataaagaaggggaactaatttcttattagacttggaaaaataattttaaaataggtagatatttgctgtttgtggcctgccattagtggcctccttgaaaatgattaattactatgtggagaataataaaattgtaaggaaataggcttttcttgaaatcatttctttaaaatgtggaatgtaatttgctttgcttaatctggttttctttaatgtatgcaccagccacaccctcataagttaacatttctatagaaaaaagttatatttgtgttgctttcttactaaccaaatgccttcttttgttcaaagatgggtggaacaggaccctaaggaaattctacattctgtctatgagtgtatagagaaaacatgtgagaaacttggacagctcaatattgatatttccaacataaaaggtattttagtagaatattttacccacataataagactctctcaatcaaattcattaatttattctttcagcttataattgagtgcctatgcagtgccaagcatttctatgagaacttgaggatacaacactaaagaggaagatttaagttcttgtcctcatggagcttttatttggatgggggcgagataataagagcagaaaaatataatttcaaatactaaaaagttccattccaaaaaataaaaaccaagtggtatggtgggttttgcctagaagggcttgctttagattaggtggccaggaaaagcctttctaaggatgtgacacttttgctgagctctcagagggcaaaaggggtcagccatgccagtgtctagaagagtgtttgaggaaaaggatgcagcacgtacaaaggccctgaagtgggaataagcctgggacatttccgggtcagaaagaaggccagtgt

SEQ ID NO: 136720 - DNA, 1071 bp, Homo sapiens
cctgagagaacagaaagaaattaaataatatttagggggtaccaacctgagagaaaaaatggccttgttttcgacaaagtgagtgttgaacttgtaatagaagctaattctgggcaatgagaaattagatggttccaaatgtagacttgaaaattgataacatagatgtgataatctcaatttattatggatgaactcactatagtaattaatataaaattaattcaatgaaagaataggtgcctttctgtgttctaggttttgtgataacccttggcatatagtgacaaaccaggaagaccttgtacttgactttctgctacagaaactaaggatagaagtttggaagctagaaggagaaagggaaataggaaaggaggagagccactaagaaatgacaaggatagattctgccttcagttttatttcatccaggaaaactctaaagtgtcatatctccatgtaggtcttcagttgaaaatatcaacataatattaaatctttagcagttttattctaaagcaacacaaggtaggatggatggaaacaatgagattttcacgtatatttgtctttgaacttcttttgctttgtttatatcacagtctgcaggttttatacttttttctctgtctcggttcaggctgctttaacaaaaatatcatagactgggtggcttatagattagaaatttatttctcacatttctggaagctagaagttcaagatcaaggtgcttacccatctggtgtctagtgaggaccttcttcctggtttgcagatgactgtcttctcatcctcatatggcagacagtgataaaaagaaagtaagctctctctttttatgagggtactgatctcaatgagggctccaccctcatggcctaatttatctctcaaaggtcccatctctaataccatcatattaggggttaagattttaacatacgaatttggaagagacacatacattcagtccatagcattctctttgtatgttttcttccttcgttgtctatttctcttgtaaatctctgtaactctatgcctgtccttctcctctttatttct

SEQ ID NO: 136721 - DNA, 1855 bp, Homo sapiens
gttttacttttggccccacctgtttctgagaatgtcatcaggtgaggggcagccatcaatatagtctcttccaccttgcaaatgaccacttacccagcttaattaatagcttagcttttgacaaatagtaaaatgccataactaaatctgttttactatcatgtctcttgtgggagaaacaacccaataacactttgtataactgtcagcagtctgtgcttaggatgtgttccataacctggagcctcaccttcacctcacttcctatcaccctagcagctcatgacagaccatctcagagaagatttattatttgcctgtttctagtcaaatggaaatcagctagatgattttagtggggtttttttttactttattttgtttttccttctattgtcatgactaacgaaaaactggaaagttatgaggttttattattctaaatatttaaaaaataatttattcctctgtactgtttgttactatgtcactaactctagcccatggggattgaggcaactacatttatcttcactcttcaaactttttttttccagaacaaactaaatctaccagacagattggatgtgactttatttaatacaaataagttcagatcatccaagttatttttattaacttacttatttgatgggcttgaccatttacttctgctttacttggtgtagataaggggagggacataccttctagaagtgggctgtctagtgttctggactccctagcatcaattttccttctatttttttcctaattactttggaagttagcaatcccctgttccctctagacacgttgctcccttctgtgaaggtgccctttactcccagctatcttaccaggaaagtgctttcttggggacctgccttcccaaagcagccctttcatgtcttaatgtagatggccacaacacagactgtagcatgctccttgccattcctttctaacatcctctaggattgtgctccctcagtacatcatccatcatttcaatttagtggttgaatgagtagtcagttaccacctgagccacttttctaattaggatgcatatatgttgccagatagagaagagtcatcctaaacaagaagcaggtatttacctggtcttcatccaaatggaaatattattgaatcagagattcatactggacttcctttgttccctttctgctccctgcctcttccttttctttttctacaccaatgtgtagaaaaagtgttcattctgataaacttgcccaagtgatctaccatttcctaaatggtcaacaagagaccttgaacctggccatctctagcgtgaattgcccttatttcttctaatgctccagctgctccagtttctcctggcccttcagttccagttgccgttgttccctctggctcttcagttccagctcctggtacttcctcaggtattggtgctctggctattgctcacttcccagcctcccaagtcctatatgttgggggaaattgacttctgctgccagatctggatctgtcattccttttgattgttctcagagattacctacacaaggggcttagtcctccagcttgggagtcttctctttggcttttggtctctctgcaaatctaattctgccatcttagcttctttaataagttttctaatttttttgttcttaattcaattaattttgagcatttgtgaattgcttggtagtgtaccaaccactgatatttttctctttggcagttttactaatgcattccatgtattctaactgccttaatgtctgtctataaaaacacagtaattattatgacaggtttctatgatcatggaacaatggaaggagaaaga

SEQ ID NO: 136722 - DNA, 1055 bp, Homo sapiens
aaatcaatatttatcttacccagtgcactgaactctgatattttccattctaattcatcctatttcaatttttaaagtaggtaatcaaaactcactaaattcatttttaaactcatagctcactgtattttgaaacactgagtattgagatgtgcttgttaattttacctatcatagatttaaaacttttctaattcttctactttttctagttatttctgtgagccaataacacctgctaggattgcttacctgtaaggaaggtccacatttgtcacagtcatacagtactgccactgtgtaaaagtagactgcccttgttccctgggcatgggagatcttgccacctccatgatgatgtcactaatggcttgtatcaatcacagtgtaaataatagaaaattctatttcaactaaatgaagtttaaagcagggggcagttcttttgctcttggaagcagcagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaaggtcagctgagaagagggactcttgcagactgagcacaaatctctttgaccacatgtttcctgatccagtcactggggcccagacccattcctggagctgggagtaagatcaaatctcaggtacactacatggctgagggtgagggtggaacgatttcctaaaaagaattcgaaatacctctccccaacagatgcaggaggagtagatactgggcagcaaatgcagatgttatctattataggccatctattttcatggtctttctcttttccctcctgttttcttggttgtggtgagtcttttcttgctgcttttcccacctacagaaacccgtatcttgtcctgaagtccccagtttaagtcttgtggaaagtagccactgtcaaaatgaagtgcagggccctccagggaaatgacagcataagtaattagaaag

SEQ ID NO: 136723 - DNA, 1028 bp, Homo sapiens
atacaaaataagcactctaaggtttgtattattctcctaacttggtctgtaattttgcataaaagctttaaatcctctcataaatttatttttatctaacaatatgcccattcatttctaattttctaatttctatctcttaaaagctatagaattttaattccttatagaaactaatcagtcttttatccttgatagtgatttcagtaagttcttattttttaaatgaagtttttcatgtatattattttattttggtctatagtgtggcttgatctaagaacccagtctaccgttgagagtcttagtaaaagaattccaggaaataataactttgtcaaggtaagaatttcttcagaagtatactataagaatgtttctttttttaaaaaaagtttgcagatttcactagaaagaagcatcttatggtacaatagttatttgatacaatttatagaatctttttcccggataattgaggccaactcaagtctttaccttcccgtctttcttgctctgtggtggattggaacaataataacacaaaattgacaggctggaagagattataatgcgtcccagtggcttaagtcacacttcccaaggggtgctttttttttttttttttttttgagacggagttttatgcttgttgcccaggctggagtgcaatggtgtgatctcggctcaccgcagcctctgcctcctgggttcaagcaattctcctgcctcagcctcccgagtagctgggactacaggcacgtgccaccatgcccggctaattttttgtatttttagtagagatggggtttcactgtgttagccaggatggtctcgatctcctgacctcatgatccgcccacttcggcctcccaaagtgctggtgggaggggtgctttctataattgaactatgttttccaaatctatccctattttttctactgcccatcaaagaatgttctggctgcttttgagtttttaagcatctggattcagggagagagaaagtaaaagacactctagccc

SEQ ID NO: 136724 - DNA, 1055 bp, Homo sapiens
ctactatgcccagctaatttttatatttttagtagagacggggtttcaccatgttggccaggttggtttcgagctcctaacctcaagtgatccacctgcttcagcctcccaaagtgttgggattacaggcatgagccaccacacctggccctgtgttgctttaatttggcatgtctttgagctctactttagtgtctactaatttcatgttatgttatttgaacttgtgtgtgtatatatgtaaaatatattattaagtcttattgttttaaaagttttctggttatgatcattagtttatgatttggtatactctctggtttttaatagtttaaatgtcatttttatggaatataaaataaacagcatagttttgggctaggttctacatacaatactaatttattgcaaaaatcaacatctacattgtcactatctaattacaggatgttgtgtcatttaattttctctttaccttgctacgtggatgccctttgaactgtaaacatgtcaccctaatctttgttcatgaacatgctttcctgtgccatgagacaggaaaagtatttttattcataatactatgggattgccttcagggtctttgaatattttgtgatttgttgagttcttttgtttggtggttttgttttaaactgttacacttttcatttgctaactgaacttcacaactgttttagtccaagacaggccttccacttagcacttacttcagtgcagtgaaacttcgttggctccttgacaatgtgagaaaagttcaaaaggccgttgaagaaaaacgagctctttttgggactattgattcatggcttatttgggtatgtttaaatataatggatatatggagaattttttcagaaattttttctagactgccttgcctattgtttctactagcaggtcagactttttaattagcagcattatgaagaaaaaccactcaaaaagcaacaggagaagttttcagcttccattcgagaagcatttttgcctacttcctctttattttttcttgtcttacttcagtgaaaatg

SEQ ID NO: 136725 - DNA, 1224 bp, Homo sapiens
tatcattaaatattgccttgagttaatgtgtctttttttaaaattaaggttgtcaagtctacaatcagccacttaaatctcatttttcttcctagaatgctggccatcatgatcaaaataaaaaccagtatttatgacataaattaactgttgcttatctaaatttgaagaaagatgtttgctatgaacaaataatatacaatacctgaacactcttgtgtttagagcagcttgagtagaaagaaaagttgctaaaatatggccttgcaaaataaatgtgtttcatactggtttgatagctattggaagaatatattagtcatttcttaataatggcaataatagcaaagtactaatgaacttgagcaatcacgtagcccaatctccattttgtagagaaataatgtgatgtattgagaggtttcaacagcctgctagtagattaatactaactaactaaccaagagtagagccctcatttactggctcccagtctaacgttttatgttcattctccagtgccacatctcttcctgtcattctaggaatacttgtagtatctgtctctttatcattcatttagttgaaatgctttctttgtcttgtctgcccacatcctctggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaataaaaaatgaaaaatcctatggctcttctaaaaagaaagttaatactattgtattagtcagtgttctttattgtcatttatactttcagtgtttaggggaccagtctgctgcattggtgggacaaatgtgcttccagattggacaagccaaaaatacgtgagtttaagaaacag

SEQ ID NO: 136726 - DNA, 1037 bp, Homo sapiens
gaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagt

SEQ ID NO: 136727 - DNA, 1040 bp, Homo sapiens
actctgttgcccaggctggagtgcagtggtgggatctgtgctcactgcaacctctgccctccgagttcaagcgattctcctgcctcagcctcctgagtagctgggattacaggtgcctgccaccgtgcccggctaatttttttgtatttttagtagagacgggggtttcaccatcttggccaggctggtcttgaactcctgacctcatgatccacccgcctcagcctcccaaagtgctgggattacagacatgagccaccgcgcctggccttaaaatggcattttaatcctcctgtctccctccctccaaccccatgccttacacacagatacacagttctcctcactagcggttgaggatgtaattttaactgcaaaattcccacaaaatcaactgatcatttttcccttgtttgtgtactttactatcaatgaatttaaaatactaagaaaaagttgataaaacaaacaaaaaaagatatcattgctccaatttctgctatcagcattaatgataaaagtaatttgatcttttgagagttttatattttaaagaactttgtttttgtttcagttaggctgcagtggatttaagccagtttgattttttttttttttttttgagatggagtttcgctcttgttgcccaggctggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataact

SEQ ID NO: 136728 - DNA, 1891 bp, Homo sapiens
gtagtctgcccttgggcttttttatagtgagtagcatggtaatgttaatcggagcaaggtacatctcaggttagttactctttaaattagacaactctattagttagctttaatgttttcgtgtataacttagcagaaatttttcagtgtttttcattctttctgtgtctaggaagctggaaaatcaataaaaggtctaattagttagaccaattaatctttgggggcagttagaagtaagaactgtgactctgcttaccctttttaaatttttaatgtgatgacttctttaagagggactacattctgctgtcagctgcagcaataagcaaaagtgaaaatactaatatttaaatgaaaggactttcagactgactgctgaaagttaaagtatacttttgacattaattaaattgtctttcaaatgtatataaattatttttcataatcctgaaaatttgctaagcaagtcttaacttttcaattctggcaagtttcagccagagcatgtccacagagttcctgtaaaaccctaaaaccagggaagatttatagttactcttattttagttaaaagaatatcttttatgaactgaagttttaaaaatgattccttaaatgaaggggttgaaatgaaaacagaattatttttccacattaatttatactgaataatctttttttaataaaagtaaaatggctcagcatgttatggaatatattgcataatcttattaatttataatagccatttgtggaagctgctcctggtgatagctcaatttttcttaaaattactggcttaaatggaaatgatgcttcttattctgtatgttcccatgaaagtgaaacttaaaaaaaaaattcatgattagggtttcatgaaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaat

SEQ ID NO: 136729 - DNA, 4558 bp, Homo sapiens
ttatactatagagaggaaaagtcaaggtgggctgaagtcagggaaaacttacagaggcgacagaatttaacatgctataaaacatttctctttttcttcatttggctggaataaagcataactctccgctatttacaggtaatgacctaggaaggcaatctattctggacatatatccatcttcttatagcagaaaaaaagtaattagaacaaagtaaaagatcaactttctgttcaactatgcatttccagtagatatatttactaattggcttacatattaaagtaggcaattacctcccttgatttttgtggtatttttcttttcagtttggattatacttggaaaaaggttaatctatttaccttccccctcccccttaatcctaacctccctcagagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgttaacaaaccagtgtgaggggaattacagttggccaacgacaaagttgcacactgcattatttaggaaaggagggattgtcaaaaattattaagagaaaggtgaatatagaggactttgaaacaacttttaaaatttaacataactgtatctagaggtcaattgagtctctacaggcagttcagatcattttaaagcactccttatttatgaaatagaacttcagggtgcggataagagatataaagtcatgtgactcactagggtgcatcgctggaaacttaatagcacatttcattaaggtctctgccattgttggagttccttcttagctcagaattggagttttggaatcttcccctcattttggtgagtataaacagcaataaagttagtaggttctcccatcctaaaggattttacctgaggatatcgtcttaggaatatccatagacgctcccatcaggtttctcccccaacccccctacaccgcccccccacttctaatttagcagtaatctctggcagacctggaaaaacaagctgctcttaatagcataatgaaaccaaaggcgtaataactcatcatagttttccatcagaatcatttcacactctgcctacagctttgaaaacattttttcatatgtgaaaaactccccaaaatatatccactagtctcccaaaggaagcatggtaattaacactgataaaaacatctctcacacaacaactgtggcaaaactgtgaaaataacggtgagaaagcagatgggcttaaaagcatggtccccaaaacaacgttcttcaaaggtttttgtaacactggtctctgtctccaataacagtctagccgtcctactgttctgtaatatgcctttgcctttgtatggtttcatatctctttagtgatggtcaaccccacttggttttaagttacaatttaggggaaatatatatatatatactgcttggtgtcctagctaaaaggtttaccagtattcatagtgatatgctgaagtggaggcaattaacttggcagttgtcagttgagaatgaaagtagcatgtctgaaaacagtctgatgctttataaaaccatgtagatgactttaaaactattgcatgaaaatacatcaaggttaataagctgttatacagtagatgcatggtttcaatcctttggtgatattatctagtcaatcattgttttcacctgccaggaaaagagagaaaacagtctattggataggtgtaaagggtggggtatgcggtatcagattgattttaaggaagttttgtacatgttaatttttaattgtgcacaagtttcatatgccaacataggctgtattcagttttaaaataggcaaaatgacttgacactgataaatctggtatgtttaactgtgtcccatatgtagactgctttttgcctatgaccagtttgaacaagaattcacccaactttcaagatgccttttcaaaaggatcttgtagtcagttggtatgtacagacaattggcatggaagtggtaggatataaatcggatgacgcctggctgctgaggtgccagctggatcagctggtgcacttcttgtttcttgtaagaggtttctttaaaatgactagtttgatgtatctggtaacatataggcctgactatacattttacattatttcgctattttgtaaactgggattttagaaagcacgtttgccattttgttaaagtacattgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacactacattctgcatcttttctgcgtaga

SEQ ID NO: 136730 - DNA, 1048 bp, Homo sapiens
ttggctttttctgtagttcaatttataatgaatttttaaggtaaattatgataaatatgaaagtaagctttcattatttaagtgttctttctcacagtttgttcattaaaaatcaaaacaagcagaaagagaaaacagttcaaccatcctttcatttctcttcttcatttatctccccaaatgccccacatgcctaatcctgcctaaggagactagccttacaattagaaaaatattcctttaagtgtaatacattgtagacatacatctgtgtagtggttttcttgggtcttttctcacagcgatgaaaacacaatttcattgggaggacagaattatgtaatgaattttgaaatcctggaaaacatttttcccttcttatgtgttttatttacatattttctttaaaaaaaaatcaaataacaggaaaaaagagttcttaaatgcctgatgaatttactttctttataggaaactttgatccaaaagccatgaataatttttatgacaacatagaacctggcccagttgtaccacccaagccatctaaaaaaggtgagtatgaaaaatgtcacaaatacgatagaaataaatgtcaaaataatttgggatttcacatttatctgaagaaatttccactagaggttaagttgttcagcataaagttaccatatttttattatttttatttttttgagacagggtctcattctgctgccccagctagagtgcagtggtgtgatcatggctcattgcagcctcgaccttctgggctccagcgatctttctgcctcagcctcccaagtagctggtgtgtggcatggtaggcacacaccaccatgcccagctaatttttttttattttttgtagagatgggatctcaccatgttgctcactggtctcaacaaatttaccatattggtgttataatgtggcaataatgaaatgtccccaaactttagtttttaaaaagtactgaaattagtaactcttagaattactgtcagaggtaatttgatggactatataattttttacaaacagaag

SEQ ID NO: 136731 - DNA, 1074 bp, Homo sapiens
aggctcaacttaacctctactttttccatgaagcctttcctcattttcctaccctctctaagctaagggcaatctctgagtttacaggtttagagaagtgggcatatgtcaggcctcttgcagtcagcatgtctgcagccactccctcatagagaagtttctacttgaggttcttggcttcaaaggggatctgtgaattctctgaaattatatgcagagtttcataagtgtgtttaatatgggaagtgggtctatagctttcatcagattttcataagattattacattggaggaaaaaaggagtgaggaaccattgccttaaacaataggcagagagaaaaggggaaggcattttagaagagaaaagaacaataaggtaatgaaggcttgaagtcaagatggagagtgacttttaggagacagtaactacagttccctggcataagcatgagatttctgaagagttaacagaggttaactggggctttgaccttgaatgctaggtcaaggtgcttgaactttattctcctggtaacagggaacaagtgggagtttttgagagagagagtcttgagaaattggcatattcactaatttagtgacttttttgtaatatcgtgtatagtcaatattagaagtgaggaggaagattttaactacttaaagcactggaaaataacaaagttatctttaatggaaaggtgatgttaatataaatcaaatttctgcctcattttctccatttgaaatcttaattgaatcctctgattgcggaagatattgaaggacataacccatatgggaatccacccgtagtagttgggtactttggaaacctttaggtacctgtagagcataaacaaattttcttagcatagtaattttctttaatcatatacattttatttagcaactacttgctgtgtgataatccctgctaaataaaatattggtttttttttgtttttcattggaagtggagaactgtctaatgtagcataggttagtactaaaaaaaaaaaaaagaaaaaagccccagattttatatcagagctcttattgatgtatctttt

SEQ ID NO: 136732 - DNA, 2018 bp, Homo sapiens
agtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaaggtaaattttaacccttttatgaaatttaatttctgtggtgaggcagcagtctcccattcaaatatattagctgtttagttttaattaaatgtttagtattaaatgttgggcagtagcattgctattaagaataaagttagtggccgggtgcggtggctcacgcctgtaatcccagcactttgggaggctgaggcaggtggatcacctgaggtcaggagtttgagaccagcctggccaacatggagaaaccccacctctgctaaaaatacaaaacttagctgggtgtggtggcgcatgcctgcaatcccagctactcgggaggctaaggcaggagaatagcttgaatccaggaggcagaggttgcagtgagctgagatcacgccactgcactccagcctgggcaacagagggagactgtgtccaaaacaaacaaacaaaaagaataaagttagtgcttcagagtcatgtatagactttgttttaaaacatgaaaatgtaggcctaataaggcttagtttagaaagaatattcatagagcgaaaaatacaagtgacatggaaattgtcaaaagtacaaactacagagtaggaaaaaagagattcatggagaatggactaaagttcatcaaacgaaagaatttgaatcttttctaaagaggatggcccagagggcataatgatatttacatataaataatatataagaagtggaattattggattagctaaaaagtaataatatataaaagtggaattactggattagctaatagtagattattggattagctaatagtagacctaaattagatacagagtttttaaaaagtctattcagattgtttcaagataaccggagaatttagttttctttcagtatataagaagggaagtaattattcagtatgcctggtagtcagcctgttcaaaacacacataagtataaagagaatcttaggacaatagaacaagagggatgttcaggtgatgtcactttggttgcattcagagggctaaattgaagcagatgtggaggcagcatagcattagaaagacatgagag

SEQ ID NO: 136733 - DNA, 1224 bp, Homo sapiens
atggttttcttcaattaatacatctttccgtcactcaaagtattttttgaagtatttgaattttaaattttctatattgattataattgccatttgtcactatcatctgggtagaatgttaatgttttacacgcatgatctcattttttaaagtatttgaattttagtatcaaaaactttatataaagaaaaggttaaaatgatctatagagttttaatacagccaattcattaaatttctaagaattcattttgtaaagatttgctggacttttttttaaacttcctaaagctccagtttaataatgtccttttggccagacatcctttcccttgaaattatcatgtggaaagagcactgggactcaggagaataagaatctagaattggcttttctgttaactagttaagtgcctattgtcaagccatgtaacttcccaggcatctttttcctcatctgtaaatgtgcgttgaattggagcagatgaactctaataggagttctcccaactctaaaattacaacattatgggtcctgttttaggtttaacttcatttggttctcagcagaaatgaattatttcctttcatttttatataaaatgtacttttcctaaaataaatatatagtaatatctatgcatgtacatatctgtgtgtatatttatgaactacagagaaggtcacaataattgggaaacttttatggattacttcaaaagtagtggataatatgtgctttacactagtaaaatagtttggaattctgtatttccttagagaactgctttatgataaattaacattttacaaagagggaaccttttattagtctgattactgtcagttggaacttcaaaagtgtcagtttgctattacctcctttgtgagtgtagaattaaacaattcaaatctttcagtgattttgaaagtataccaagacacctttcagcgggtaaaaacttttgagactgtgagagtatgaatgaatttaattaaggcagtcgacaccaggtttttaattaaattaccctaactcgggcaaagtcatggagccgtagttcaagttatggactttttttatactgattcgttttgcttaaatcttacgtaatggttcagacagttgaagttattcaaggataaatttaggtaaaagaaaaatgagggctgctttagaatttttattgttttaactcttgaggaattttattgtaattctt

SEQ ID NO: 136734 - DNA, 1045 bp, Homo sapiens
actcgtctgtcgtcccacacctggtgaatggcatatgttctttgtctgttaatattacagcattgtgtttcagctataatggccaggtaactcttgcctgcatatgctcactgacttcccagttttatcatattatgctttcttctttctgtaagtcatataatatcctgaccccatgactcatgtcctgaagattgagacaattgggagattactccttcatatctcatcctcaccgcctcccaccccatttctagaacatggtaccaccagctctggaatttgccaacctctctgccctgttagaaagcttgctgtgtcactagtcctttctcatccctacacatacagtccctttctctctttttagacatgtctcaatttttccagttctaaaagagatgcgtctttgctttccagttcatttaccgtctttcttggcactcagggcttcctttgttgcttctccagtcactcttgatgaaatcctagccagtcttgtttgccttatccttctgaatcttaagaagggcaaaaagcttatctgccttgtacttcttttccagcaatagagtcaatgctcctatacttctagtgattctgcttctgaaccgccctcatatctcattttcaaatcattgttttcagcatccagcaacatccttgctactcacttgtaatgatagccttgaacaattattttacgttaggcctgtgaatgtcaaatacccttgtttatttgtaggtacttgacatttgaacgttttatttgaacatttctaaatgtacacaaatgaaaggtccaatgaacctctgatgctacagttacatacgttttaccatactagtttcatctccttactcctcttttttccaagaattaaggcatagccaagacataatttcactccccaataatttaacatctctaaaacaacacattttcttacatagctacaatgttattatcttatacagcacatacaatacagttcttaatagcacatataatacagttgacccatgaacaaagccgaagttagga

SEQ ID NO: 136735 - DNA, 1383 bp, Homo sapiens
tcatttatacttaatataattattgacattttggggttaagtacagcattgcatttttattctactagctctgtatttctttttccccttgtctttttcttttatttgactatttttatatcatttttcctttattacttcagacatcacttattcatttttattctttttgtgattaccctagcatttatagcatgtattcttcacttatcaaagtctagtgttaattgatacttctaccttcctcctagttgaagcaagaatattaaagcaccttagttccatttacctaccttgtgacatacatattgttgtcctgtaatttaattttctgtatgtattttaaaccttacaagacattattttatacagtcaatattcctttagatttcacgtgcttatttgaacttcatgggtcttcattcctttctctatctgtgaccttccatcttgaggcagttttcttttgcttcattcttagtgagggtttgctggagatgaactctgtttttatttgtctgagcctgtattttaatttttttcttgaaggatattttctcctcagtggaatactaggttggcagttgttttcttcatgcttcttggagatacacagtcttttagctgccatttttgttgttgaaaattaagctatcaatctaactgttgcttctttgaaagtaatctccccacctctgcccctgctgcccctccatcaggatgctttaaaactttcctttgtctggtaggaattcattgagattgttacacatgtggtttgacaggtttcatcatttttggaacatttattcaaatattgcctctgccccattctgtctcttttccttctgggattctgattaactcttggatattagacctttctcactgtatcttccatgtttcttaccctctcttcattctgagcgttttattttcccccgacctatcttttggttcactgtctcaacggtgtctattggctgttagacctgtttattgaattcttagtttcggtttttgcatttctcagtaataaaattattctttgcttcttttaaaaatctgctgtgtagcccggacaacatggcaaaaccccatctctacaaaaaaaaaatacagaaattagctgggcatgctggtgcatgcctatagtctcagctactcaggagactgaggtgggaagatcacctgagccccagaggtcaaggctgcagtgagccgtgatcacgccaccgcattccagcctgggtgacagagcgagacccggtctcaaaaacacccaaattctgctgtgtcacattttatgatttctaggtcattgctgagatttttaagtttggctttcatctccttgaacatagcaagcataatttaaaatcc

SEQ ID NO: 136736 - DNA, 3558 bp, Homo sapiens
gcagttttgttgaaagagcatagttttggtttttcataaaaggaatatcttgttcccaccatgaattactgatgatttgaaacttttcaaaggtattggacctcttgcagttattttaccctcatttatttagtgtaaacatgggacagtgtgtttgttttacttcaagattttaaaataaagtgttagcgtgttgaggttacatactgttaccactgtttgtgatgttcagacaattaagtgagggatatgaaggtaataaaaacaaagctaagtacattttaaatttgttttccataaatgtgttcagtcttatattggttgaaggaaatactcctaataaaaggcaagatggtttttttttttttttggtttccaaaccactctttcgtttgaaaaatgactttcagtaagcacgctgtgttcattttaagagtttaccaagttatttaattacacagcgagtgcagaggttaaaaatatgatctcggggtaaaatgcccagatgttcagatctgacactaactagctctgtgttcgtgggcaaattacttaatctctgacctgttccctcatttttgaagggataatgtggtacctacctcatacaaggattaaatgagccagaggatgtatcatatttaaaacatgcctagcaatggtgaatactcaaaaagagttagttcttattattacgttgtcgtcatcattactactattattgttattactttagctactttcgaagatgatacgccttctgttctggggtgtgggcatgaaagatatatttgtttacctggtagcaattttttaatgcagagtttatttgagaggttcagggagagagcagtatgttaactgctggatatatccacaattggccatagtgcaggaaattcatagaatattaagcttatttttttcagtaacaccattccttttgttaggtataaagaactatgcctttttgatgtttgagcaaaactagattatttgagtaattgcaacgtctttattaaaatacagttatcttggtatctaaaggctagagtctgtgcagggggagcctcaatttctaaatgatccattggtaagacttttttttaagcagcaccattttcccacagaaaaatgtcacataatagtgttcagattcccaagccagcccaacatatctgaatttgaatactgatagtattataaaaactaacttttatgtgtaacagtgtctcagcaggaacatgcactgagtacatcaagtactgaaagattatgaacacaatcttgcagatatggcagtagggctatcttcctttgcagtcctagcaaggaccgtcaagccttgggaagagaactctctcctctggtagaggccgagggtaagtagtggagactggtctctagaaggcagtagcttttttctggcttggctccttaaaaggctgtatagtatagtggttaagcgcatggactgtccactcagagtgcttatcttcaaatctctgttctattacttacagaacttcccatctgtaaaatgtaggtaaaagtagtgcctcccttatggggttcttgagaggattaatgtgttaatacgtgtgtagtgcttaaaatagcatctgacccatgagtgagtgcataagaagtgttatgtattttttaattattcagcttgactggtctaggatctctagaatacttttgtctgcttggctgtccactgcccacatcttttgcactaaataggattcttctctttcctttctactgaggaatggtttcagactcttcattcctgcctgaagtattttttaaggggtttaggggggtttattttattttttaatgttggagaaatagcattcttctgtgaacccactccatttccccatttaggccttgtgttgatggagatcatcatttgaagaaagatattgactatgggcatttaattgagtcagaattgaggtgcaaatttctcaacttttagtagtttttgctaagtcatttctttttaaataagctttttattttggaataattttagacttacaatgaagttgcaaagattgtacagaattcctatatactcttcatccaagtatatataaccctggtacctttgtctaaacgaagacattaacattggtacattattgttagtgagactgtagattttactcgattttaccagaatctcactaatgtccttttgctgttccaggataccatgttgcactgagttgttaagtcatttttaattatttgtttttatatcatggagccctccagttctttagtgaatagatttctgtggttgtaaagccattttctgttttagttttaagttttctgcacatactcgaaggctaggtgtttcctctagggatggcaagtccagggatttatcttggcactgaactttataggttgaaataaaaggagagagtcctattactgtggaaagaacactatggtgatggagtgtaggctaaagcatttttataatttaaaactgtgttttcatgggactaaatgagttattttatgcactattcacttttgatggatttgatttcaaaatgacaagtcattcttcctattaaaaaagtgttaagcatacttcttggatatagaagctaattgaaatgaattggagaatttaattttttagtactcatcatagttatgattgatttaataaattaagttagtataatttcagtaatttagaacatttgtttatatgcgcttttagaaaatccttggtttcgatttgtggcaacaatccagtctttttgtttttttcagggataccatatgtaacaggtgccattgttactctaacttttcacacatgccttcagtttgatgtcaaagtcatcatttagtgtaaacagcaagttatctgttaggctgcacatcatgaactttacttttagaaagtcttatcttttatgccacagaaatagcatttggctattagtcatggatggcaaagaaattaattttgagttgtttggataaaaatgtttcagttgactgtagtgtgtattgagagacactgccagtaaacaaactctcttggtaggtggaaatcccctagaagttacagaaaattgggaggaggtgaacttaattaaataacttgaattgtttagacatattcagagcttcttatgaccttgaagaaatcacccaacttcaaaagacctcggtttcttcatttgtaaaattagggagtttgactagatgtgtaaatctagttgttagttaacttctaagatgtaaaaaccctcttgtttaacaaaaacctacaagatcaagttgcttatctgaaatctttatgaatcaacactagtcactaagtctagatataagtcagtttatcaattgggttcaaatagtttcaaaccaatattactgtaagtttgagagtcactagttggtttgacacctcttgtatatttttggtaattagtatattgctttttaaaattttgttatctgatttttgtgctttaccctgaagcaatgaccttcaaacttttttct

SEQ ID NO: 136737 - DNA, 1048 bp, Homo sapiens
aagagaaaaagatactaaatgtctggtagtcatcctccaccaagtcacttagtcaggtttagctgcctagttaattatctctggctgaaagttctagaaaagttttgaaatttggggtttgctgcttcatcttttaagaagtacattgtttgggggccttcagttaagtagtcctgtcttcatggaaacagaaaaaggagtcttgtgttcctcagtacacatcagtatgtgtgtgtattatgtagctttagagactgttttaagtaatcccttggcatcttgatgggcaatctgtggtctgaataagtttttaaatatagttatactcccaagaaagcgttaaataaaatatacttccttacttgtgaaagtaattactcatggtatttgggctatttattagggcaaaaaaaaaaatcaacaaatgataatgtaactgaatgcttaccaagtaaataaagcctttctgaaatgatttatattgccaccgtataaagataaaacaccaggaaattgcctcatatctacttataagtttattttcataccttctatatggtaaacctcaaattattaccatggccacaaatatttatttctctaaaagtgaaatggacttgatgaaatatttggaactatcaaactgaattaatcctaaataagaacatttattatagtttaattcatggacagttctatttgtccaactctaacatcctacttccctccctgcttcaaatttctctactttccatcctctccttctgatgctgttcctaccatttacctggcacccttagttttccattgacactgaagtctttgatagggtggatgctaacaaggaaggcaccaaaactcctccaagtcccttctccaccatcccgtgctctaggaggtcaagagggatgcggataagatctcttaccccaccctgttctttcttgaaaaggaggatgagaatagccaagagtgagggaggcactgtcaagaccctccaatggtttctcctcttcttccctctccttaaacaccaaggaggaaagtt

SEQ ID NO: 136738 - DNA, 1019 bp, Homo sapiens
gtgttgagtaaggagaaaacactgctttcctttaaagatcgcacaagcagtcctctgaggtccaacaacagattagagttattcccagttggagttctgtagtttactaccgtgtgccagctcataaagtgcgtaaaagcaggatttgaagggtgagggacaggtgaggcataaagtaagctgcataaaaagatccaaagtttgttaatgtgttaaagtgtaaatccttctgtttctactgaaatgtaacttatttaaattatttaagaaaacttgccacctttggtccagaccgggcttgtcagttcgatgtgtttcttcagtgacgtttgtcaatcaggcagtcattttggcatacagtatatttacttctggtttctaaaagaacaagaatgaatgagaaaagggaacagtttggcaaactgagctttctttgcgcactttttcattttgaaaggataagagaatttacttttttctttgctttagtaatgatttgcagtagtatacaagaacacgtggaagaagaaagggttttttgagatgagagtttaattttgcacagtgttaaattataaagggcctcatcacccatggtaagttttgtgatggtgtgttttatgaacaccggaagaatacaggcacatacatatacatgctttttagtcagtgtgtgatatgaatctttacaaccgtagggacagcccccgcccccacttgcttacaactggcttaatcaagggaaagacttcagtgaaggtaaatattaaatatgtgattttcatcttcacatctgaaagaacataatctgcattcagtcaccctgaattttcatccatatgtttatttgatggagtcttcccctcagttatagataccacattgtgtacagtttgttggagcaaacagagctaacgtcgattatattcaggcactggagatcctcacagctaccctatgctaaagataatgttatgccgattgcacagaacaatactaacctccaatattctttggcg

SEQ ID NO: 136739 - DNA, 1079 bp, Homo sapiens
gtttgtttgttgtgttttttgttttaataatgacaagtatattaattaagtcagtttgcagttcatactttgcttctcaagagaatttcatatcacttctattcttaatgtcaccatctaagaggatgcatgagtgagtagtaagaaagagacacctaaaatgatgtctcacaactggttctggggaagaagaatcccttaccatagtcaaccaccaccatggggagaacctctcctttgcccctgccctgctctgtttcttgccctagctgcaaaggaagctgagaaagtgggtagcaatgtcagcacttcttagggagaggctatctatctttacctattcccaaggttcatggatggggtgggcggggttccccaacagtgttcagatactggtgagccaaaggaataacataagtccaccaggtgcagcctatcctagtgattttggaaataataggagatgagatgatccatctcattagaaatgatgtttgttagtagatgtggcatctctgctgtgaatcaatcacttgctaattttttgaaagtagggtgatgatgctgacctaagtgactaccacattgaaacacttcccttgacatccacacataccaagaaaaattttcatcctatttaaataaacaaatcatttatccttcccaccattacccgaacctacctttgtttgaaacacccagactggctgttttggtgacacttaaggaggtaactgaggaatcttcaatacttcaccacgtctaagacaactgtgtgtggatgactctgaggagggcatttggttttccattccatacttggcacacactagaagagacagaattaattcagttaaaaattaaaatgaatcgagctggcacagattatgcaccggcaagcaaaatgtgtgtttgtttgggagaaagcaccaagactaatggatgtgttctgtagagctgcgatgggatttccctgaatttgtaatgctctaatggtggaatgaatacaaaggcaggcactggcgcacttgcaaagactttgccttcaaattaagtgtaggaaggacacaaatcaaatt

SEQ ID NO: 136740 - DNA, 1095 bp, Homo sapiens
ttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtattgactggactgcagtactttgtttttattttaatttagttgttgttacttacttacttactttttaaataggtaatacatgcatatgagtaaaaaactataatccagaaagacagtgaaaacactcctaactaccccttcccccatatcaatcaatcatcctcattgctctatgagtagacattattaatttcttatttagtcttccagagggtctttcttt

SEQ ID NO: 136741 - DNA, 1878 bp, Homo sapiens
tttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaact

SEQ ID NO: 136742 - DNA, 1050 bp, Homo sapiens
tatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgc

SEQ ID NO: 136743 - DNA, 2231 bp, Homo sapiens
ttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaaca

SEQ ID NO: 136744 - DNA, 1845 bp, Homo sapiens
gcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcatttt

SEQ ID NO: 136745 - DNA, 1175 bp, Homo sapiens
atcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttt

SEQ ID NO: 136746 - DNA, 1045 bp, Homo sapiens
ttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttcca

SEQ ID NO: 136747 - DNA, 1051 bp, Homo sapiens
aatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggt

SEQ ID NO: 136748 - DNA, 1022 bp, Homo sapiens
tgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagcta

SEQ ID NO: 136749 - DNA, 2075 bp, Homo sapiens
taaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttata

SEQ ID NO: 136750 - DNA, 1016 bp, Homo sapiens
aaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaa

SEQ ID NO: 136751 - DNA, 1429 bp, Homo sapiens
ctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattc

SEQ ID NO: 136752 - DNA, 1732 bp, Homo sapiens
aagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatt

SEQ ID NO: 136753 - DNA, 1016 bp, Homo sapiens
aacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgg

SEQ ID NO: 136754 - DNA, 2458 bp, Homo sapiens
gctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatg

SEQ ID NO: 136755 - DNA, 1427 bp, Homo sapiens
tggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatca

SEQ ID NO: 136756 - DNA, 1038 bp, Homo sapiens
agattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcag

SEQ ID NO: 136757 - DNA, 1066 bp, Homo sapiens
ataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacag

SEQ ID NO: 136758 - DNA, 1045 bp, Homo sapiens
gggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttg

SEQ ID NO: 136759 - DNA, 1008 bp, Homo sapiens
aaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgact

SEQ ID NO: 136760 - DNA, 1035 bp, Homo sapiens
tctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatt

SEQ ID NO: 136761 - DNA, 2853 bp, Homo sapiens
tttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactt

SEQ ID NO: 136762 - DNA, 2120 bp, Homo sapiens
gggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattac

SEQ ID NO: 136763 - DNA, 3482 bp, Homo sapiens
gtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgag

SEQ ID NO: 136764 - DNA, 1109 bp, Homo sapiens
gcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactctt

SEQ ID NO: 136765 - DNA, 1994 bp, Homo sapiens
ttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctcc

SEQ ID NO: 136766 - DNA, 1061 bp, Homo sapiens
cgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacat

SEQ ID NO: 136767 - DNA, 1048 bp, Homo sapiens
gtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacag

SEQ ID NO: 136768 - DNA, 1024 bp, Homo sapiens
aaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttca

SEQ ID NO: 136769 - DNA, 1178 bp, Homo sapiens
ttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttct

SEQ ID NO: 136770 - DNA, 1079 bp, Homo sapiens
attcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaact

SEQ ID NO: 136771 - DNA, 1132 bp, Homo sapiens
caaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcat

SEQ ID NO: 136772 - DNA, 1002 bp, Homo sapiens
aaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggt

SEQ ID NO: 136773 - DNA, 1283 bp, Homo sapiens
attatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagatta

SEQ ID NO: 136774 - DNA, 1065 bp, Homo sapiens
taatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccat

SEQ ID NO: 136775 - DNA, 1048 bp, Homo sapiens
aagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaac

SEQ ID NO: 136776 - DNA, 1030 bp, Homo sapiens
tttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccacctt

SEQ ID NO: 136777 - DNA, 1030 bp, Homo sapiens
aactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctga

SEQ ID NO: 136778 - DNA, 1061 bp, Homo sapiens
atagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttc

SEQ ID NO: 136779 - DNA, 1033 bp, Homo sapiens
tttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcag

SEQ ID NO: 136780 - DNA, 1046 bp, Homo sapiens
tttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttagg

SEQ ID NO: 136781 - DNA, 2603 bp, Homo sapiens
gtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccacctt

SEQ ID NO: 136782 - DNA, 1849 bp, Homo sapiens
ttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaa

SEQ ID NO: 136783 - DNA, 1020 bp, Homo sapiens
cacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttg

SEQ ID NO: 136784 - DNA, 1044 bp, Homo sapiens
gtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacag

SEQ ID NO: 136785 - DNA, 1053 bp, Homo sapiens
gggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaattt

SEQ ID NO: 136786 - DNA, 1046 bp, Homo sapiens
ttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagt

SEQ ID NO: 136787 - DNA, 2981 bp, Homo sapiens
ttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgag

SEQ ID NO: 136788 - DNA, 1022 bp, Homo sapiens
ctcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaac

SEQ ID NO: 136789 - DNA, 1085 bp, Homo sapiens
ctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaa

SEQ ID NO: 136790 - DNA, 1009 bp, Homo sapiens
gagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaata

SEQ ID NO: 136791 - DNA, 1033 bp, Homo sapiens
ggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattt

SEQ ID NO: 136792 - DNA, 1020 bp, Homo sapiens
caggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatg

SEQ ID NO: 136793 - DNA, 1008 bp, Homo sapiens
tcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatc

SEQ ID NO: 136794 - DNA, 1058 bp, Homo sapiens
actgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagata

SEQ ID NO: 136795 - DNA, 1036 bp, Homo sapiens
tgaaaaatgggaagaggacagttcaggaagagatacaacctgacatttttatagattgcaaatttcactacatttctacctaaaaatggtaccagtaccaaatggcagtaattcctgggaccactgaatattccgagctaactcatttgccttattgacttatttcacatttgtgactagggaaacaatacatcattgtaatttttcccttctgaatttcctcttacaatggctgattgttaaagaattaggacagataagtgctacttttactcttctaaataatgaccaaaaaaagcccataggctaatgtatcacaataagatattagaaggagaaaaatcgattgtcagtaagacactttgtaataaatcttacaacagtgaccttgcttggctgctatatactgtataaagaagagaagccaatcaaaactgcatgaatgattaatgcatttcatacaaagctcgatgatatccttagaatatatttgctaaggtgctgcagtcataagaagtcaaacaaatgtgagagctcaagtaaggagtttcagaaggagttcttaagagagacacatgcagctaatttcttagtttctgttgactgtacaaatggaagtactgatatcagaatacatgttgtaaggaaaaaaagacattcagattgccgtttgaagttatgaaaactaggggactacatagtagatttgattactgagaagtcttataagaggattctgcattttgttctgttgacattaggtttaataacatgattttccttggtcaaacaatgcgtgccattttgcagcacaaattttaagagtgaatgtgtggttcaccatatctttttttttcttcctgcctcaatgtatagcagagttgcagctgctaggtatgtagaatgactgagcctctgagatatttaggttgtttgtcactgcagcatagcataacccatcctgacttatgcaagttattgggcattaatattagtagaaactgaatttggggaaactgaggaagaaggaaaagaa

SEQ ID NO: 136796 - DNA, 1047 bp, Homo sapiens
agcatgaggcatttaagagtgctgtattttacacactatatttaagtgtagcaggaataagaatagagtcttaaaaatatatccggtcaagacttgcttcctcctttctccacaatctttaaatgcaaatacatgcatactgacagctctcagaaaaataggcctaatgagaactctccctttcccaagggatgccctctgccaccatctatttatggaataatagctggctccctacttcattcttacatagtacttttaaaagagcaatttccatttttgaagtattgctgacaggaaataagtaatcttttatcacagtcaggaaaggtcagcaagtcagtaatcctccattcgcttactgaaagaaatatccacttttcttccacagcagaccagaaaagtgatttatctgagattggcattaatacataaaatggccaatgcacctagctatgccagagcaatctcttacatggtccagaggcttcttttattacctgctaaggctgtgaattgaatctgttggagcaagcattgtagataggatttccaatctcctcccaagcactcttccataatatcaaatcctggcaaggccaagacattttcataatgaagatcgactcagaagctgtctttgctcttgtgtcctgatattgaccttttctttgcattcggttgtatacacacacacacccacacaaatttacagaagtttttgtgtttcttacaactgtatttcatttcatatgttcatttttcagctctccaaccattcaacaagttttattgcatctttaatatgggcccaatactgtacaaggcagcaggacattactaaaaatataatcttagacttctagggtcttagaattcaagttgggagtgcagtatgcacatagaaataattattccttatattgtggtattacttacagttctcaaagtaagttcactaatcttattgcaacctgatacttttactaacaatatagagtatgtagcaagattttgatcaaatttaatgtgtgcttaagcaaaatg

SEQ ID NO: 136797 - DNA, 1031 bp, Homo sapiens
catggaatattttgagttactttcccccattgttcaggcttgagtaaaaataagttttccctgtctgtctcagacagtcaataaacattagtacatatttagccaggcatttgagctttgaggatgttacaagtatgagccaaaatacagcaaactactgctaccaatgattgcatgacacctttgaatcagaaatgctctaaaagatgagacaacaattaagccctcttatgctcattcaaaccaaaagtgctgcttggcttcagttaggcttgtttgactactgtgctgtttggatggagaaatcacttgtaatatgctattttcctgaagttgggctggtttttattcataagtataaatatgtataaattgcatacatttatatactttgaatggtttgtatagtatctattttgaaatgagagcacttttaaaattgtttgtaacttatggaaatataaagagtaagaactgggggaagttatttaataggaaaaggaagtcaaagatttggatcttccaagtgctgccatttagtcatgattgcatgctataagagtgcgcaggtatgagaaaaagtagaaatctggccgaggcgggtggattacctgaggtcaggaattcaagaccagcctggcccacatggtgaaaccctgtggtaaaaccctgtctctactaaaaatataaaacattagccggacgtggtggcgggtgcctgtaatcccagctactcaggaggctgaggaatcacttgaacccaggaggcagaggttgtagtgagccgagattgtgccattgcactccagcctgggcaacaagagcaaaactctgtctcaaaaaaaaaaaaaaaaaaaaaaaaaagagtagaaatctgactggttgatggaattgattaactttggagtttatgctccacccgtaattatttcttagagacaaacagaagatttggcaggcagtcacatttgtaccacatgaccctacacccctggtcaaagatgattacacagagatagttcctgccttta

SEQ ID NO: 136798 - DNA, 3927 bp, Homo sapiens
aggagctacttatacggtttattagtggcacaatttagtttaactagtactacttgccataataataatgataattatatttttaaggtgaaaatcactactttgtatgctcatataaattattatattgcactaattattttatctatactaataatgatttactaattaataggataattcttatatattgggaaaaggtatttaaacaaaaaaattattagtattttaaagtataccatctagaacaagccatctttaaaatttttggcttttatgtatatttgattacaaagttactctcatacatatatagttacatatttatattattttatttgctgcaaataacattttctaattttgatttgcttttctttcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtttgaatttgtgtcgtctctgttgtgtaaactctttagacaacgcttctaaattacatatattcattacattttctccttcaaaatatatattatttagaaaacatcttaatatgacatgct

SEQ ID NO: 136799 - DNA, 1026 bp, Homo sapiens
tgatctaaaagagcagccctcatccctgtgttctgtctgctttcttgcatttcttgtctcttagcaatatgtgacattatattctatatttgtttactaatggactgactacccatgagagtagcagctttgtctcttttgatagcataatgccttaaactgtatcgctttagaaacattcagatatttattgaatggatgcatttattgaatgagtaaatgaattactatacctaacccacattcttgtttcagtcatatcctggtaggatcagtacagatttgacgagtgaacagagtatagaaacctaaggagaagtgccttttttttttcaaatgtacttggcaactttggaattttcttctctgtagttatggttgatagtaattgacttcttgttagttttaagacatttaaaacatgaaagctcccttttcctcacaaaggcaaagagccaactgggctttttttaaaattaatgcacattttagcacttactaactggaaatagatgaagtgtgggtcatacaatatgccgtcagctgagtcctaacaacaaccaaaaccttttctgagaaggtctgatttctattttggatatcagtagggtatcctcttatacaaacttacttgtgtatccactctcagtagtaatggtaggcaaagtgctgactcagcagtgttgtgctacacggcagaaatgttgggtgtttttatatctagttctaggtcggtcctttgacacctagccagagccttatagaaagaaattttgaggaatcatttcctcatgaatttgctgtatttcatcagttttatgggagagaaagatgactgttatgtagactttctaggaatcttcatcatactggtaataatcttttacatgggctaaaaatagatgagagtacattttaaaacataaaattccattttaattaaacactctatccatcctagtgttcttttttaaaacatataagcgatatcaaaactatttatgtatatagttttactatgtcagt

SEQ ID NO: 136800 - DNA, 1048 bp, Homo sapiens
attgtttcttttatgtcaattttatatttagggaccaacctggctggtagggcctatcaacctttgcctttaaattatctcctaattttgtacctttttttcgtacaccatcattattgccttagtcgaggccacaacttttccctaaatggaacgtctcattccccaaatttggtcttcccctactttattttgtttttctatggcaatatctgactgttttaagatgtttatgtgactcctttattttgccttgttgagtatctagtttttcagttctttcttttagtctttctttagattccctgacttttctttcccactgatgacaccttagtcatcactgcctacaggtccccacacactgaatgaccttctaggggcctgtccttctctaatctcttccccatgtaatctgtcttggatacaacacatgaggtctccttgtgacataaacatctggtcttgtcacttgtccctttgatttcttcagaagcaaaccctgagacgagaaatcaagtgcatatactttatttgtaaggtagaagaagggatatgataaagagtatggaaaatgagacgggaatgggaaagcagccattaaaaggttacattatcaagccagttgtcactcgaagcagctggagcttaatcttcttggggaaactttaaaaaccggtgtagaacacgcacctcgagaataatctcattcagaggactacggagctggagtattaatgcaccaaatttggagcgtcattggttgagaaatgtcggttataatcaagggagagcagtgttaattttctggacctggcctgccccataggcagctgaagaggctttagtggccagaggtaactcaggcaaagaaatacaggtgctggcaattggaagtcagggtagcatgtactgaagtggggaagataaaaatatatggataggacaccaaccgcatatacaattacaataacctcgcagatggtctccctagagaaacaaaagtttattactttatgaaacactatggtattatagtatgaactaa

SEQ ID NO: 136801 - DNA, 1049 bp, Homo sapiens
accaactcaccacctgtttttgtagattaagttttattggggctgggtgcagtggctcacgcctgtaatcccagcactttgggaggccgaggcgggtggatcacttgaagtcaggagtttgagaccagcctggccaacatggtgaaacccagtctctactaaaaatacaaaaattaactgggcgtggtggcacatgcctgtaatccctgctactcgagaggctgaggcatgagaatcacttgaacccgggagacggaggttgcagtgagccaagatcgtgccactgcactccagcctggatgacagagtgagactctgtctcaaaaaaataaataaataagttttattggggcacagccagcttgtttacacattgtctgtggctgctttcacactatcatgcagagttgagtgggtacaacagagaccataaatcataaatccaaaaatatttctcgtctggccctttatatggaaagtttgcttatcattttctaccttagtctgtctttacaaaatgcaaaacgtgtattttagctatttttttgaggatatttaaaatagagaaaagtgatcaaaattcattcctgtttgaattatggctgaaagtgaagagtcaaatgtgtggcattttttttcacactgagctatgtgaaagagctaatcaggaaaaaacaatctattgcactttcactttaagatattttatatgggtagatatttagttacattttgatttaaatgaatccaatgctttaaagtttttacttatgtaaaataatttagggaaagttgctaacagtaataatcgttctataagagtaatagaccaactagaacatatggagcataggctttcttaatcaaactctccaggaattgcatagatggatggatggatggatggatggattttatttttttcattgtacacttttatataattaaactttgatttttttaattcagaaatttcaatttacacacctgtttttagaaggatttccatcatgccaaagtgcaatataattgtgcacttgtgtaaactt

SEQ ID NO: 136802 - DNA, 1095 bp, Homo sapiens
aaatgaaaatacaagtgccagtctgacaaatgtgagtgtgatttaaaaatcagtgttttaatttgtgatgagaatgatagaaaagcgagaatcatccataaaaacaacggaatacattgaggggaatactacccacctaaacagtaggacttctgtttatgaggttaaaaacttgtttttccattgctttttaattatatctaattttctaaaggaaataggcattatgtgctcagggatttacatatagtagaaagaatctcagcatataaccagtagctacagaggtaaataaattagccagtgtttgacaagtgaaaggtttctaaatgaggtgagtggaggcagaaagctttaggaactggttttgtgcattgcccttggctcaaaaatatcgaaaatgtatccttgttaaaattttgtcttttctgaaaattggaagtgacttttgatcatgaattccctaagggaatgataattctccaattggacagttataatgtggtccatagaattttcataatgcagtggcgatttcaggccagtctcatatgttacaatgctaaaataagtcagcacaattctgcagaatactaaactgtttatagacattggaaactctgatgccagctaataaaaataccttgaaagaggacttgaaatcagttcctgagttgcatgttaatgttaaacttgatggtgtagtatagggactgcccgatttttatcttgtaactgcaaggggaatataacattatgtgtatgtattttcctggagtttttttttctttttactttttttttcctgttatagaaaacactagtagagaagcatacacttatcttgagcctccacttctttcggtgcagtttgaatgcccccagtgtgtcactgtgtcaattttgccaaaattcttttgagagaacctgacacgtaacatggcagcctgatttcaggtttggttttcagatccaaaacatgcctcccatcccattcgagccctcaccaatttatcaaccaaggatgtatgttatttcctcaaaactgattatcacctgttctctgtggtctcagaaaccaaactcaggtttcca

SEQ ID NO: 136803 - DNA, 1080 bp, Homo sapiens
tgccagataggaatagcattgaatctgtaaattcctttgggcagtatggccatgttaatgctattgattcttcctatccatgagcatggaatgttttcccatttgtttatgtcttctgtgctttctttgagcagtgttttataattatccctgtagatctttctcctccctggttggctgcattcctagatattttattttttttgtgtggcaattgcaaatgggattgccttcctgatttggctctcagcttggctaacaatagcttaattttaagttgaaaaagaatttccaaattttgtagaagtcaaccatgtatgtttcttaaattgattaaatgaatattaattttcattcaacaacttaattgcattctggctttattaaaagtatgtattaatttatccaaaaagattgaatgttctttcagcagaatttcaacctcacacattaaaggcactgacatttcaattttactaatcttttcaaactattggttcacctcccttgaaaattagacaaggacacctttccttaatgtttttactcctaagtttgtgtgtgatttgggtacacttgtagatcatcaattttctattctaatcatggacactgaagactctcacttaaaaaatgtacaacgaaacatccatggtcttccaaagaagtgagaaaaaatatctataacacctttgtctctatcagcttgttgactgttatgaggtttaaaatgatattttaatgagccatgtttcaagagatcacatatttatactttctgttcaaaatttctgtttattaggcaaaaccatgttaaaaaaatagaagtcgagacccctgaattacttattctctgtacataaaaagggacagacacaaaagaactaaaattttcatcaaagaagattttattgccatcatgtttaaggtccctaaaccaaatattcaccagaatgctgtcatgatgctctgtgaatgaagcctagaatctattcttagctcctctaggtaacttaaaggggggtacattcgaatgcttccctctattttcccatcttctcacatatactcaatgagtta

SEQ ID NO: 136804 - DNA, 1881 bp, Homo sapiens
atgactttctcttaatgtcttttagattttcaggttccttagatttacttttacaaaggacattttaatgtgtgaacagatataatttctcttttgctcacattcatagaaggattataattcccagggagccacttagatcagtcttggcagctaagggatttgatgggtgtgggaaaagcctggcctttcgtaaaacatttcaaaacaaaacaaaaacaaacaaaagaatatctcaagcaatagattttacttgctgtcgggaatacatttcaagaaatttcctgcaagtttttgtttaatagtaagaccacttgcagagaccatagatatagtcagtgctactagacatgctagtgaaaggaatatagatgcttcaaaatgtgtctctggaatacctaacctaaataccacagcagggagctctctgaaccacttctggttctgagggctaccccaaaataactaaccgaataaataaataaataccacaacaaacttccatgtgagctatgctaaattgtaatgtaattctgtatcagagtagagtagtatgttggagaataaatgagacattggattctaactgacctgaacttggccacttaccaatcatgtgacctcatacaacttaatgtcctcaaatggtttatcataaagattaaatatatgaaagtgcctgtttgttagtgttatgtttcttcctggttacgtattcagaaaatcccagtgatacttttttcaataattgaagatttttcccctttaagtagtaaaatctctgcattgcataatgaattgcataatgaagtactttgtcaatttcaaatttaaattttgatatgcattacctaacatttaacaatgctcttggtagatcatgatcacaaaactattatccttttattcagtcctattacaagccagacacctcagttattcccaatgtcacaataaacttgcaaggtagctaaagttatccctatatattattgaggaaactttggatttttgttaagattaccaaggtctcaattaactagtggtaaagatggattcttaccaagagtattccagttgctaatgctgggaaactaaccacaacaaaagttagtcgtgtaaaataaccattttattatactcatgaattctgtgggtcaggaattcagataggacataatgaggatggatgtctggagcccttgtggaagataacttgaatggctaggaaccagaacgtctggaactgtagggtcattttccaaatgatttcgctcacaggtttggcaccttggtggggaaggctgtgagatactgggcaaagctgtgactctccctggaatgcctacaggtggcctttctagcattgtggtcttaggatattggaattcttacaaattgagtgggtcccgcaggacaagagtcataagagccagaatctctctgaactaggctgagaaatcacacatgtcttctaccacattcagttggttacaaaggagccatatggccagcttggatttaagggaaggagaattgaataccaccttttgatggagcagtggcaagttcacattgtagaagagaatgtgggataggagttgctgttgggccgtgtttggagcacacagtctgacactgagtctaactgcaaatctgcattctttattgcctttgaagaacaacaacaacaacaacaaacggccaaccagtttgtctttgctttgtagcttctgtacttaagaactttgaattgattatataaataatgtctgactgggacaaaaccttccctcagccagcatatggctttaatgactggttacttgtactttggatatgagatggaatgaactcgagaacctaacttttccacaaaca

SEQ ID NO: 136805 - DNA, 1082 bp, Homo sapiens
aggtagctactgaggctaccagtcccagggggctttactgctttccgccctccctgaccctccagttgccttccccggcgccccagttatgcccttagcaaaaatcagtcaacttatgatttctcgctacaaaccccttcctttctaattttgattcttcaactgctggtgtcagcgaagagaaagggaaataaagagagaggacctgccggcgattttctttctttctctctctttctctctctctctctcacacacacatacacagactcacacacacacacatagacacctgagaaactcattacattccttccagtttcatgtcttctctgggactatttataaagctttcctggaaacgtttcaagttgtaacaaagttgaaatagcacaaaaagccacaaaaatctgattttcttttgtctttggtttcctgttataacacaggaaaatttgaccaagtttcttctgtaaatttaattttgtgtttaaaaaaggctttttctttgatactacctcaaaattcccattgaagggtttcctctttgttggttaattcactgtggagggaactggttggcagcaggaggtcaacatttaggtccttcaattctttcagggttggcagtttacaactaaagataaaataaatcggcagaatttctttcttcggtaaccaggggatccaaataaactttggcgaaaatatctcctttcccctcttcaataataaaatttatgtaggaatgacagctactgcacgactccttggcaacgtgaatgttttgcccctttctctctgtctcctgaaataatagacccctgattgcataaagacttttcagataggttagagaaaccagtttcaactcacatttgcttttcaagccagtacccttttttcttggccaggaatgtagggaatggggagaagccagctcgagtttgcagagcaacatacagtgtttgctaaccttttcttaattgcctccatacccatttatctcagcttttttcctctctagtcaaggaaatatggagacgcaagcctaatgcaaatatagcggtaatagcactctg

SEQ ID NO: 136806 - DNA, 1056 bp, Homo sapiens
ggcactgggctccgcccgcgggccagaggcggggtaggggcgggacaggcgcgagcctccggcactgggaactggagccgaagccaccaagtgctggccctccgcccctccccgtacggcaccgcctcccgcagcccggggaggggccggggcggagcgagcccggccgagccgggaggagcgggcgcgggcgctggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccggaaacccgccagcttggacatctggcactgcgagtccacgctcagcagcggtgagggcctggcgcgccgcgacccctgcctcccgccccggactgccccgcgccccactgccaggacagtcaccgcctgtccccacgtccccgcatcctctgccctggcccgtcccaccccgtccaggcccttctcggatcctggggctcccgccacctccctggcatccacccctcttccctccccatccctggtcgccaaacctaaagcgacagcccacgccctctcccttccccgtggccattcctcctgttctggagtaacacgtacgctattttgggtatttgttatcatttgaggcgagagccatgtggctgtgtaaaaaaatgcgacgccttccacacccccgttaaaaaagaagcaggcaaaaacgcc

SEQ ID NO: 136807 - DNA, 1077 bp, Homo sapiens
aaaatacagtgctgaaaagaggatttcagtcatttattctgctcctgcgtctcttcttctttttttttaaatttaaaaacaatcatgaaactatagtttctctgtctttttttctgccctttgttggggggtgggtgaggggttattggctttattttccccaataagaaagcaaaaactagtgaataggaatttgaaaagcatttgcccagatagcttggaatactttacccacacacatatatttttacattttattcacttttaaaatttataggcagtagaaatcatacttgttgtgcattcccaataatttgataaatgtatatgcttgagtaacaatgacaagaaacaaaatccaagagttctgtcaagcccacaatttcccttatgctgtccatttaaattcaatctctgtccattcaccagcaaactctgatttttaaaaaaatttaaaaatgtttctatacatttacatttaccaaaatgtcataaaaataaaatgatatagtatgtacatttttttttagtctggcatctttcatttagcacaatacatttgagatttatcatgttgttgtatatatcaaaagttctttctttttatagctgaatagtattccattgtatggatgtatcagtttatccattcattagttgaaggaatttgagctatttctaatttttggtgattgtgaagcaagccattataaacatgaatatgcaggtttgtatgtgaacataaatttgtatttatcttggataagtacctgggagtgagattgctgtattgtatggtaagtgtatgggtacttttataagaaactaacaaactattatcccatgtgaatgtacctctttaaaaattcctaccagtaatgtctgagatttacagttgctctgcacctgctccagaacttgttgttatatttgttgctcttcttaaacattttaatgggattatttgccatctatatgttttccttgttgaatgatttattaaattttttttagttttattattactgagtttgagagttctttgaatattctagatatgagtactttgtgaaatat

SEQ ID NO: 136808 - DNA, 1054 bp, Homo sapiens
aacacgcacctgaacaaccaataggtcaaataggaaatcaaaaggcgtattagaaaatatcttgttcccataactgcgtgcgctctcccctcccattctctttccgccatctttccgcattgccacaatggtgctcatgaatgtcctggctgatgctctcaaaagtatcaacatgcagaaaagagaggcaaacgccaggttcttattaggtcatgctccaaagtcatcatccagcttctcagtgtgatgatgaagtgtggttacactggcaaatttgaaatcactgatgatcacagagctggaaaaattgttgtgaacctcacaggcaggctaaacaagtgtggagtgatcagcccagatttgatgtgcaactcaaaggtctagaaaaacggcagaataatctgattccattgtgccagtttggtttcattatactgacaacctcagctggcatcatggaccatgaagaagcaagacgaaaacacacaggagtgaaaatcctgggattctttttctagagatgtaatacatatttacaaataaaatgcctcatggaaaaaaaaatatattgagacaaatggaaatgaaaacacaacaaaacaaaacttaatgggatgcagcaaaagtagtattaagaggaaatcttataatgataaatatctacattaaaaaaggcagatctcaaaataagccacttaaattatatgaactagaagaaggacaaactaaacccaaagttagcagaagggagaaaataataaaaaataagagcagaaataaataaaatagagaatagaaaagtcatagaaatttgacaaaacaaagagtattttaaaaataaattttaaattgacaaaccatgagtgagattaagataacaagagagaatactccaataaatcaaataagaaataaagggggagacatttcaattgatttctcagaaatataaaggaacataatgactattatgaacaattatctgtaagcaaattggaaaaccaagaaggaaatgtatatatttctagaaatatataacctaccaagattgaac

SEQ ID NO: 136809 - DNA, 1162 bp, Homo sapiens
ccgcggcggaggtggggccggggccagggtcggctggagcgcgcagggcgggggaggggaggccgccccacggcggcccgcggggacccggttccggcgcgcgcgggaggcgcctagtgcggaggcggcccgaggcctagtgacaggcgcgcggcgaggaccccggaagcccacctgtcagagttaccggtctgccgggcgggcgccgccagtgtccggggtggacgccgcgagcctgcacgttgcgccaggaccccggggctgcgcccagaaaaatcatttttcttctctgggaaggtgaacatttgtagcattgattttccggatctggtaacatggcaaaagatgccggtctaattgaagccaacggagaactcaaggtcttcatagaccagaaccttagttccggaaaaggcgtggtgtccctcgtggccgttcacccctccaccgtcaacccgctcgggaaacagctcttgccaaaaacctttggacagtccaatgtcagcattgcccagcaagtggtgattggtatgcctcagagacctgcagcgtcaaacaccctggtggtaggaagctcacacacccccagcactcactttgcctctcagaaccagccttctgactcctcacctcggtctgcagggaagcgcaacaggaaaggagagaattgcaagggcctgcggcatttctccatgaaggtctgcgagaaggtgcagaggaaagggaccacttcctacaacgaagtggcggacgagctggtagcagagttcagtgctgccgacaaccacatcttaccaaacgagtcagcttatgaccagaagaacataagacggcgcgtctatgatgccttaaacgtgctgatggccatgaacatcatctccaaggagaagaaggagattaagtggattggtctgcccaccaactcggctcaggaatgtcagaacttagaggtggaaagacagaggagacttgaaagaataaaacagaaacagtctcaacttcgagaacttattctacagcaaattgccttcaagaacctggtgcagagaaaccggcacgcagagcagcaggccagccggccgccaccacccaactcggtcatccacctgcccttcatcgtcgtcaacaccagcaagaagaccgtcatcgactgcagcatctc

SEQ ID NO: 136810 - DNA, 1015 bp, Homo sapiens
aaaggctggcggggacccgcggtggctaggagagacgtggcggcccaacggctgactacttgggcccgcgccgagccaggctttctccacggtgcgtgtgggagtgcacagaggggcctcgacggcttttctgtatgtgttataaataaaccccaatagtggaaagctccagcaggatgccctgagccctgggtcttcccagcagaagcggtggaggatccgcccctcgtttcccacccccgcgccccaccctgttcccgccccttctctcttaaccccgccccagcccagcccccgcctctttccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgg

SEQ ID NO: 136811 - DNA, 1001 bp, Homo sapiens
agctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaac

SEQ ID NO: 136812 - DNA, 1052 bp, Homo sapiens
taattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatata

SEQ ID NO: 136813 - DNA, 2035 bp, Homo sapiens
gctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcat

SEQ ID NO: 136814 - DNA, 1054 bp, Homo sapiens
tggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttc

SEQ ID NO: 136815 - DNA, 1105 bp, Homo sapiens
ctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtctttt

SEQ ID NO: 136816 - DNA, 1050 bp, Homo sapiens
attatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagc

SEQ ID NO: 136817 - DNA, 1040 bp, Homo sapiens
aaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatc

SEQ ID NO: 136818 - DNA, 1542 bp, Homo sapiens
tagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaat

SEQ ID NO: 136819 - DNA, 1046 bp, Homo sapiens
ctgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaa

SEQ ID NO: 136820 - DNA, 2015 bp, Homo sapiens
attagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagagattttttttctgccatgtgttaatcatattatggttaggtggtaaatacgctgcatatgttcttattaattatgttctttttaataaggtaaaatggttatgtttcttttttcttacggatttagggaatataggtcagtaaaaacaacagaaatcatctgatcaaaacctcagagtgttctcagcataagaaagaactttctatactacttttgaatgactttggcatgatacaaaatggaaacaattgctctaaaggaatagactgagctccctgcatagtgtagtttgtcaagtcctgggaatagtgttgtctatagacgccaaggagcctgttgtttcctgcttagcagaacagcttgcatttgaaaagaaagcacaagatgaaaacattgtgaccaaagggcatcttcctatgtgtagagctcaaagactaaaagttggtttgtcacatcactaaccaagaacatgagttgatatggtaacaagaattaaaattatttactccatattcaaggatgaattttaaatataaattataagtctaattttataagcaaaagtcctcaaagagttgttcaaatagtctttaaaa

SEQ ID NO: 136821 - DNA, 1055 bp, Homo sapiens
cccacatcagcctggagctccacgcatcctatgtgtacctgtccatggccttctacttcgaccaggacgacgcggccctggagcactttgaccgctacttcctgcgccagtcgcaggagaaaagggagcacgcccaggagctgatgagcctgcagaacctgcgcggtggccgcatctgccttcatgacatcaggaagccagagggccaaggctgggagagcgggctcaaggccatggagtgcaccttccacctggagaagaacatcaaccagagcctcctggagctgcaccagctggccagggagaacggcgacccccagctctgcgacttcctggagaacgacttcctgaaccagcaggccaagaccatcaaagagctgggtggctacctgagcaacctgcacaagatgggggccccggaagcaggcctggcagagtacctctttaacaagctcaccctgggccgcagccagaaacacaccagagcccagacaggccccacagccacggggtgccttcccctgctcgcgccaccaggcgggacgtccatgttcccttttcagaacattctcttcatttttctcctctcagttttaccgttgttggcaataaagttatctgttctcaaagcaataaaggtgtccagctgatgcgtatctgcagcactctcaccttttaggaatcagggcacatccccatgcaggtttaaagtaggtattcagcagtctttccattcagccctgccccatctgcatgcagctcaggatctgcgggggtggaagggaaaggtattttatgggcccctggaaaatacattagtcttccccttataaactttgagggcatgtgggatggggtggggtgaggtggggtagggtggggtgagatgtgtggggtgggtggggtcgggtggggcgtgctgtcttgggccatggtatctgtgggtgtgtatgcatggtatggtataaaacatggtatggaattcatcctagcggttgcctctggagaagaagggaagggaatgagattgggcggggataaaaataatagtcttt

SEQ ID NO: 136822 - DNA, 1041 bp, Homo sapiens
ttaaattgcttttagttgcatattctaacacttgcaatgaaaacatctcaaatgataccctcacttttttcgtctatgaaactgagattaatttaacttccctgcctaactcatattcactgaccttacattgagtggtcatatgtgccagaactgggcatgcacaaacgagcaaaacaaagacccacagccacccagagtagcccatgatgaatcactctctccattgcaacaaaaacttacactcattgtgaaagcatgaaaaacacagataaatggaaagaaaaaaagtaccccatattctcgctatctcaggacaactaattgatattccagtgtatttcccttcatactttctgaaattttgtgttttctgtgtatgtgtgtgagtacacacatgcaaaaaacagatgatgttgtgccaaaagtttataagcttatatcatgtaaagcaccacatacaaacataaaaagctatcccttcaactccctcctcacaatattcctctaagaatatatgaattaaagctattatcattagattagttcataaaatacagttggtccagaaaacagcaaaaaattaagtaaggttttttcagaatctagtcaacgtgtctggccaaagtagatctctgggcagcgacctgatcaaatagaagatgattgcatcaggttatcaaagttcagagaactgtagtataaaattagacctatgaatcctagcctattcagcctgcccccaaatacagcagaagtgaaattgcaggattgagttattaagagtgctttcctaggaatccaagagtcaataaacacctctgaaatcactaattcaaacaccctatcgtgaccaccaccttctatccatctgacttgcttgcctaagagctactacaattgttttttttaatttttaccaaaccctccagtgaaataaatcctctattttcccacttctagctaagaatacttggtgtaaaacttcattcattctcttgcacaaacctcaaacatgcttacccttcaattctgtcacat

SEQ ID NO: 136823 - DNA, 1048 bp, Homo sapiens
tgatttaataatggatccttagagtttggaaatttgtaaccacacatacatgtataagtaatatacaaagtatatcactaatatgttctgctttacaatgctccattgaattagcctctcaggaaaaataacttagtgcaattacttcccagtcaactcaggtaatggtgtttctaccttttaaatttgattagtagattccagtctttccagtgaatgacatcattaattaaactcagtgccaaaagactatgagaaaaactgatgctttgagtaagagtgagcttctctcccaggcaaataaataccaaagcttcagagtttttatgtctaattatagatgtttttccatttattcgtaaataggaaaaacctttattcctatacattttaaattgtacatttagatagagacaattatgttacatggacagaattacatagaattgaattttaagaatcaagcatggataaagctacaacaatcaagacagtgtagtagtggcaaaagaacagacaaatagatcaatggaacagaatagagagcctataaatagacccacataaaaacagtcaactgatctttgacaaaagaacaaaaacaatacaatggagaaatgataatttttaaaattctagacacagaccttacacccttcacaaaaaattaacctgaaatggctcacagacctaaatacagaatacaaaactataaaattcctagaagataacataggagaaaatctaggtgactttggatttgatgattgctttgtagatacaacaccaaaggcatgatccataaaagaaagaactaataatctgaacttcattaaaattaaaaattcctgctctgcagaagacgctctcaagagaataaaaagacaaaccacagactgaaaaaatatatttgcaaaagacttatctgataaagggcttttatgcaaaatgtacaaagaacccttaaaactcaacaataagaaaacaaacaatcaagtaaaaaaaaaaatgggccaaagaccttaacagataccttgccaaagatgga

SEQ ID NO: 136824 - DNA, 2840 bp, Homo sapiens
atggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcaca

SEQ ID NO: 136825 - DNA, 1086 bp, Homo sapiens
accctaaaacttaaagtataataaaaaaaaatgtggaccactgggcaatcactgggcagtcataaagataaaataacatatatacatgaaagtgttacgcataatgtaaaaagcttatagaaaaaataatcatttctcaggtatgaagctacattttaataacctgaaaatattttaagtaatacatttattatgcatatattttcaaagacaagaatgatgttattgattatggtaatatgaaggttacctcagattgttaccactttcaacctgctcacaatgtaaattctgttatcaataactaataatagaaaagaacatattattatatattcctgttaaacttttcaaatatagtacacgtaactctgtgaacaaatcttccctctagggcgttccctagaaagtcctcgatttagctagcagtgtttgcaagtttgcattttctctaacaattcttaatcaatcaccatcatcatcatggtcatatcaattgctaaacatgtcctgtgactatgtgatagtccaggcatcaatctaaaatctaaaaagatttgtgctttacaatccacagtgaaagaataaacaaggcaatgctttaaatagagtttttttttaaattaatcttttctttatatcaacttggatataattaggcaaaaattgggaaaatatgtgtcatatctaatatcagtttctcacagtgccaaattaattaactagaataatggtgattaaactctatagactacttgattattgcagaggaatataatttttaatttaagctttcaagaataaatcttagactgcaaaatcagggaattttctggatttgggtctacttctcttctctcatttttttctcaaccagagatgtttgggatttcaatcacaagtgtgaggatattggacattactgcataatgggtatggtgagtacttccttatgttcaccacagtctagtttgctactaacagcttaggagagaatgaaagccaatgagggtgggagaagataaactgttagctaatgcatacaggttcagttttcttcatctccatgtctagtcaatgcctttc

SEQ ID NO: 136826 - DNA, 2068 bp, Homo sapiens
caaagtcaaactgcactttttaaccaagtacttatttaattctgattaaattctgaaaagactatcaacagtattgctttgtacctagtaacaagtataccttcagaccgatatgaaatgtgaaaacttaacaggttgaaggaaataagatattaaaacatgtgaaaaatgtatgtgtatatatatatatatatatgtgtgtgtgtgtgtgtgtgtgtgtgtgtgtgtgtgtgtatatgtgtgtgtgtgtgtgtgtgtgtgtatatatatatatatattctctgataatttttatgttttgctggtatttcaaaatcctttttttgtgtttcaggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaa

SEQ ID NO: 136827 - DNA, 1040 bp, Homo sapiens
ctagcatgtgagccctagttcaaatcccagctgtttcaaagctacttgttaaccaattgatagcaccttttaatttccccaccataatttttatgacataatttatcattagtcttccttgtgttatagatattcgaatttttttattagcttctctgctagattaagttatttacacagaagccatgacatatttatctttatatggcccatagtatctcatagagtgagataatgcaagtggaaactctttcaaaactcttaagcaattagagacagtgcataatcaatgtttaccaagtgtatattttctaagatgccttattgagctataagtatattttatgttttgaataaatttttactgcaatttgtgtaaaaattgttctttttgaacaattttactgactaaattaactgccctctgtgcccttttagtgtgtagatggggttttaggtggtgaagattataatcacaacaacatcaaccagtggactgcaagcatagtggaacaatccttaacacacctggttaagttgggaaaagcctataaatatattggtaagtatcagtatccttcctcactagttcacttgcttttgtcattgtgattttctctgaattttgagaaggtatatgtacaatagacatttaagttggatactaaaagggtataaaggacttctgatttactcattcaaagataatctataataatacttaaaagatgaagatctttcactactcaaaggcagtttgagctacttttctttggtagcatcaccctttgcatttccatcagttctttctttccactgagacccccccttagctcaactgtgtttctttcggtagtcccatgcctctttacctgtaattccacacagcaactgtttataaagtggagtatttcctgcatttctgtgtctgaattctgcccatggtacaaagcacagaatttgactgatatttttcctgcaatacaatcaccaatggtaatgacaatggtcagaaaaccaactgaatccagtggggtcaa

SEQ ID NO: 136828 - DNA, 1045 bp, Homo sapiens
catttcacgttctctaaagctgagtaaaaggttatagtaaaaacacttagagaagtatattgtatattcttatatagggagaatataaaggaagaaagaaatctctgtctgccccatattcatatgccaattccctttgatctaagtatcctaaatacctaaaaggtgatcatattaggctgatacattgtaaactcacccttgctctttaaccctactcccaccacaagctagaatggttgtctgcagtgtctggtctgggacacatgtcattaactgattgatagaagacatttccacaaaacgaaaaggctttggatatagatgtatttatttgtaaagtgccacttgtaatattggccacatgaaacctttatttgttctcctctatttttcttctgaagaccttgttctagctaaatatttgctgaaacatttttgtaacctttttgtgttttaacttaataggcaaagccatgctgttgttgacactaaaagcacggaaaagaattacatttgggcagtattttaaggggtgcttttaaattaatctgggtgagaaattaagtatacctcgtatctgtatagataatatctgaatccttgactggttaccagtaaaagtaggagaaaatccactggaatatatatatgcttctgaagagcatatggtctgtgaacattcccaacagtggaacatgaccagagcatttactgggaggatcaaaagatattctgatgttgccaggatgctatttggcccatgtggatttgcgcattcaatcagtaggtttaatatcctttgtaatcaatgaaaaaatctgaataagaaataatagtccattcagctcacagggaatttgtgataaccactcattattattgttatttcctgaagtagtttaccttgtattttaccaaaaatatttgggacgaggtctgaaacttctgctcaccaaggtgccaaactggcatcaagacttcaggccatggaaaatctacctccacagatggagtcaaatctgtggaggtagcttttcctcct

SEQ ID NO: 136829 - DNA, 1049 bp, Homo sapiens
caaaatagcagcgtgaataataacctctcccaacttccaattcatagggagtttctcaaaccagcccctcagttcttgactgtgtgatgtcttaactgctaacttttatgggccatttgttttaggagggtggtcttttaagcctgaatctctgggaaatttgggtttagttctgaaatagaatcagtttctaccttttctaataaatcctgggctctgcccagagacttatttttaaagtgaacactgaatgatgaagcatttatgtgcttgggagaccacgatgaagaaggtatgcaatttcttctctctcgtagctttctgtcttgtggggaaatagagacatagttatttcaggtggtcaatgttataatacaattggattgacaggcccggggagcacagagaggagctatgtgggaacactggaattggttattgaagaatgatgctgagacttgctggtgcggagatggtggcactaaaggcccaagaaaagtgaaagtagaggatgtgtgggcttctctaagaatgttttgaaattggagacaaaaatctgtgtgagtgtcctttttctggggagacggctctatcccgattcaaaaccactagttactagagcaccttcatgaattctatgagaaaatatgcacttaatgggcagaaaaatcaacatacagagtaagatgaaattaccacagtaggtaaactttgattgaaccagtgagcaggtggcctttccagttacagccagctgtatagtttccagttattttcatttaaaaagcagtaccaagcaaaacagatgtaatcgtaaattgtaattgccttcaggcctgggctggtaacttgctgtacccccctgccccacttagtacacagtgtgacttgggggaggatctttagtcagtatttgtggattaattgattgaagtaattgtgaatcaaagtattccatttcaaatctcccctgtaggatttaaccagaatttccaagatgacactttcctgagaaaacggattgcaagatagctaaatgtcaaaggaaa

SEQ ID NO: 136830 - DNA, 1152 bp, Homo sapiens
gtgttgatggtgttgaatgttagaccctgagaggtcttgttttagggtggaatcctgactgccttttggtgaaaggaaaaactctaacagatgctaagaatgcaccatagtacatgtggtgccccataaagagatgacaaaatcatgttcttacgtgttgaaaatgatatcccctaaatactgttaagtgaatgtttcacttatggaaatgaatatttgtgtgtgtggtttttttcctagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttccactgttaacattgataagtattaataaaattaggaggtacttggcattagcaattgacaaaatgggggcaaaaataattttaaaatatagaagtatgcaaaatgcatttacccctgagtaaagaaaatttcagtgcaactgtataaatggtacatctgtggaaaactgagtgcagaagtttctttgcttcccagcactcctttctttttttggagatggaagctctctctgttgcccaggctggagtgca

SEQ ID NO: 136831 - DNA, 2847 bp, Homo sapiens
attagagagaaagagagggagtgcacgagtgtagctgggggtggagggggagagagagagagcaagagagccagagcgagcacaagtgcgcatacgtgtataaccaaaacagaagccataatgctatcacaattacatctgctttattttactggctgtgcacatacggaccaacctggtataatgggcaagggaactacacaagagtatgaacaccaggacgttgtaggtcattggggcccttcttaggactagctattacagtgcttgatacctgggtagttatttatcccaagggaatagtgtttgcctgttcatatgaatgaaacaattgtaatctaattggtgtcaatgtttttaaactttcacaaagattttaaaacctatgtcattgtgaatgaattcttttcaatttccctgacatgaggttaaaggacttttagtaaaattatacctacactttatattatagaataatttctgttttctgtccagttgcctttcacttttctgttgaaatctggatttcctttttcccatttaatcattcagattatttgctagatgaaatgaccaaagaagcagagatagataattcttcaactgtagaaagccttggagaaactactgatatcttaaacatggtaatgatttcctatctatttatctaaatatgagtttgaattttagttcattgtgtatgtgaatgtgtgtatacttcctatactcttatatgcatgaaagcgtctttctcgtttcttactttattttttaaccaactatattgaggtataattcacatacaataaaatttgttttgatcctcacattattagtatggcaattgagagcggattctattactatctgaactgttttcccttcattttatatatatatatatataaaaaaatatatataattgaaaatatactatatatttgtactatatacaaatatatagtatatatactgtattctttttataatatatattttttatttatttcagacacacatcatgagcctgaattccaatgaaaagtcattaaaattatcaccagttcagaaacaaaaggtataatatgaagatttattttcgttattgttggtgagagcagtttaagttaattttttggatggtttttggaaagaacacaagaaacgtaagcatttacttactttagaatttaaaagacagagggatacaatgtagataacctccattttgccttgttctgatggtatgtattttctgtaaagaaacaagagtggaagcattttattgctgaaatttgctctttgggatcattaacttaagttataatagccatacttttccttctgtcaagccataggttatgattgcagttcttatgtataggaaaagactaccatttattgatagagtggccctctgactttggttgagtatgactttgaattaattactatgctgactttactgaatgatattaatatcttttttagttttaaaattttgtgattttagtgaaaatctttgataaccttttccaatatttggttgggctttaatttatcaagaaattgatagcataaaaataaaattaaacatttggaaattagagactgttcatgggtaggaaagagagacttttaatgaataacaaattgcaaaagaagggaataggctgtggttttcacaaccatagagagataaaggcctgccctgaaatcctttgcttttcctggctttaaggactagtgcaatgaatgaatgagggattagaggattaggaaagtaaattggagaaatgtaagttgagggaagaagtctataaaaaatatttagtttctatttatagtgtctttgacatgttttcaagtttaaaactcttaaaattgaagtcactgaagtgcaagagaatcatactaaattgttaaaatttagagctagtcctcattcgttctatctataatactgaaaggcatggtgaataacagcattcctttgaatatgggagagctgttcgaacacagttgtagaagctcaatgaatattgactgatttttgactgaccatacttccaagcagacacctttcttgtgtctttccttcctcttcccttagactccaggctctccctcttctgggctgctttattgtgctagggaaagaaaggcatgtgcctttagaaatcagttctggcaactgggccttcctctcttagggctcttaaaagaatcatgactttttaaagagcaatagcaagaacagccagaaacggaaagcaattccttttaagctgacatatattttatactttctatagtctttttaagtttaggccctaccaggcctactttagtaaatgagaaaagatttattatactatttctgtgtattaacttgttaatttttaacttgtcatgttttaataatttctttggcacaataggaacctcttcctaggcctaactcatcacaatttataaaatttgaattagtgaggttttactatccagagacccaaattcattagatatttgcatccattagcttgtttgtagaatttagatcaacaatttggttttgccttattttgtccagcaggaaattaattttgtattgttaatgtattattcaaatgtcagtgtttgatttcatagtttttgtacaaatcttacattttacacttaatattctttccttagtgttctttcatttatagaaattattgtaattaaataatataatcaatgcaaggaagaaggtcaaaaatttgaaaactcatgaagattttgtttagaaaagaaaaatatattcattattatttagtttatagataaaaaacatctcatgtg

SEQ ID NO: 136832 - DNA, 1048 bp, Homo sapiens
ccaaagtgctgggattacaggcatgagccaccacgcccggccaatggcaaataatttttgaaggagacatttcttttctgaaaattactgtaagtttcaaaacatatttctttttttgaaggttcatagcagttttatttgtaatagccaacatatttctctatttgataggggtaggacaagaaaccaggaccaggagatcagaaagtaagcagtaaatttgaaattaagaagataaacctgtcatcagggactaagaatcagggactaggaacagataatttgtgtatctttgagatcaggaagctaggcaaagggttgaggtaataaaggattgggaactcaggtaagaattgtgggccatgggaatgggatattatatataactaggaccttgataatgagctgatttcttgcacctgacccacaacttttgtatgttttcttttgaaataagatcaatgtctaatggtactcttcagccctggacatggaaaaagtagtagattctggcaagcagtatgtagtgtgtacaaggaaaaaatacatttatggtttagggaaaattgtttctcagtcccagagatttgaatgtgaaaatatgcatgattttgtagctagatcaaaaggaaatgccatctcttgtctttttgtgactgctaacactctcttaagaaaacattttggaagttgtatctaacatatactttaactttttctaaatcattcacagacttcaatctttataatggaggaaagtggatcaggatatatcttactaaggagttgtcatttaagctaaaggataagaaagagatggctacacagggagactagatgtatttcaggcaaagaaaataatatagacaaaggtttggaggcagttaagaagaaaaggacaaccagtggggctagaaagtgagggaaagggtaagataaagcagtattggagaaagagatggtgaaaaattatttacggttttataggccgtgagagacctacgtgatatgaatgtttttcttaagtgagatagaaagtcattaaaag

SEQ ID NO: 136833 - DNA, 1033 bp, Homo sapiens
ttatgaaaaagcatatatggaaaagttgagaaataccccatcagtgttttgtagttgttgttaatttacatctcctaagtaattttttgtttcttagggagtgtagagaaaatgcacacacacttttccctggtcatgtgaaaaataaagcttccaaattgaaatttagagcaactaagatacagagacaacagagcaaaatgtttttgagcctttggggattattaagaagtaaatgttgtggagtgttggcatactttgaactttctcttaaatattttagcaacttttaggaaagtttatatcaatattaaatatataacatcatgaaatagtttgtttaacctgcttattttaaaggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccaggtaacatttgctactctgtctgctctcaggataaatgtgccttttattcctgtagtttttatgtttatcttaagatgttttctccagttatttaaattgttctctccctggttagagcctaacatcactcatttgaactcaaatccgggaatatccttacaagtagaaagcaccatcagtgctcctaagactgccatgtaaccacagcagcatatctttatagagcagtggataacagttatagtacattccttaactttatcccctttaaaccctgaaaccacttgatgaacttaggagggagttatagtcttcattttagagatgagaaaagcaaggcttgaagagatcaagtgacttgcccaaggtcactcagcttataaacgaagtggtcagaatttgaatacaggtcttctggatctatgtgaaattctgtatttaggcagtataacatagcggttaagagcatggactatggagttaaactggggtcaaaagccagtt

SEQ ID NO: 136834 - DNA, 1018 bp, Homo sapiens
ccatagagagtgtggaaagatcaatagagtaaattcaaggcagaatttgagggggataattataattgcagtatgagttaacatgtttatctgtttacaaatagatccatacaagtaacacttttataattctcttcattatttttgcattttagatatcggccttatgtatacttttggagatggtcgccacggaaaattaggacttggactggagaattttaccaatcacttcattcctactttgtgctctaattttttgaggtttatagttaaattggtaagggcatcacatttccctgtttatattttcatattactgtatttgagtctttcagtatttcatagaaaataagtaattttatgtttgtatggaagagtatcatatatatatctaataaatatacttgtttcctaaaagccaaatgtcagacattatgccattcagaaaatgtgttgctcctaattttcctcctttagcctcttcctttttgctgaaatcttgtctcttctgcttcattctcatatatctgttgaaagctgggactgtgccatgcccgcaggctttgtatcttgtgtagcacccagcagagtaccttgctcacaatagtctttaataaatatttgctgaattaaatgttagactctcaaatcctgcacaacagaaagtctgataataaacaaagcgttttggcagggcacggtggctcactcctgtaatcccagcactttgggaggccaaggcgggcggatcacctgagatcgggagtttaagaacagcctggccaacatggtgaaaccctgtcactaatgaaaatacaaaaattagccaggtatgatggcacacgcctgtaatcccaactacttgggaggctgaggcacgagaattgcttgaacccagaaggtggaggttgcagtgagctgaggtcgtgtcactgcactccagcccaggtgacagtgagactctgtctcaaaaaaaataaaaaataaagagttttgaagatacggttttttggct

SEQ ID NO: 136835 - DNA, 1004 bp, Homo sapiens
ttggaggaagtgccatctaaatgggtaaaatctgctatcttaagatttacttaacatatttactgcacacataagtgagttttctaaaaccagtttcatataaagcaattattcattcatttattccacaaatattaagtgcttgttctagacactgctaggttttggggataccatagggagcaagacaaaattcatgtttttatgggagctttaagtaagtaaaagacacaagatattcttcacttttgtgaaagcactaaagtaattttctagttgtttattagtagtggtagtcatgaatttttcatgaaaatgattggattaaaataatcaaggggaaaagaaaatctagctttatttctttatcatacagtaaaaatatctcaagaaaggtcaaatgtattaagtgatccttgtcaaaacttttttttgacggtaagaccagctttttgttcatatgtatgtcatcactaatcactatacttttccttcaatagcagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacgggtatgtgtggagtccactgttctgttccctgcgttctgtggtggctaatgaaatttttttaatgttcattttttttatgttcatttttttattgtggtaagaatactatgagaactaccttcttaatagatttttaagagtataataaagtatttttatgtataggcacgaccattgtacagcagatctctgaaacttatcttgagtaactgaaacttcacgcccactgtacggcaactcgtctttccggcctcccctcaattcctggcgaccaccattttattattagcctctatgagtttgactcttagatacctcgtgtcaggtggcctttgcatctctttc

SEQ ID NO: 136836 - DNA, 1150 bp, Homo sapiens
ttaaattataaggaaaaaaaatgtagtgaaatacgtttcttctgttcttttttcaaaacatcatttccacagtgctcccaagagcaaggtcttccaggcttttttgacctgcaggtgtctaatgtgacctgtgctgtctttcagttcagttgcaggtaggctgcttggaaggaggagaacatttctgtttagaaacatcagaatgggaaagggtgattgtaggaaagggcattctgtctttgctatcgagataaaaatatggtcaggacttaagtgatttacaatcaggctgttctgtgttctttatcattatagaagcatttcacaatataaattgaactcttaagtagctagctggtgtaaatgtcttagtagtactttattgttaagatacataatttttatgaactaataaaataaatggtcttttggaagtataatagcttcagagcctggctaccttttaaaaccttttctcccccttttatttttctttatagaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaagtaagacacattttgaagtcatcatgttatctcccacttctatgttgttattaaattaataatgaaatgatatagtctctggttctatagaaataatgccatggttgtccatgtaatgaaattattttggtctgttttaggtcacagtatttccccatttatataataagagttcataatttcaaactctgtctgacatgatcactttttaggtgaatatagagagctcagcatgggatatagtttcctttggtgggactttctcagcattcccaacttctccctttcctggacccactggcaaccttttctgtcttagttaaaatattggaaatgttgggctctagctgttatagtctatatctatctacactagtaataatagaggaagtgtgattatgactttccatctaattgatgggatttttcaacagtaaaaacacctagaggaaatagtttatggaccctcttagacaaatctttaaatatttattttatac

SEQ ID NO: 136837 - DNA, 1022 bp, Homo sapiens
aaattaatggacacatctcttttaaaatagatttgcattttaaactagtttggaagttactttccttgtttttactctgaattaataaagtgctatattagcaagaaataaatacgttccatgcattctgttcatttcagttgctagttacattctagattgatttctaaaatctcacaaaaatatgtggccttgcttgttttgctttattttgacgatgaaatgaagttgtctcccaaataataggatagtgatagctttcaactttcttcactgttaatagaggaaatcgctgctatacactgacctgtctcataaaaagggggactctatagtctattgacgttttcttttccatgtgcagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactggtgagacttgtttctttttcagtctgggacacattcctttcctgtagatcaatatatgccaactcagtaaaccgaagggagcattgctgtttagttttctttcatcgactatctatgtgctttcagaaaacatttaaaatataactttaaatcttgacatactgcaattttatgcttatttatgcttattttatgcttatttgtgcttatttaaatatacatttaaaaagtaattggcaaataagctctaagctatgccgtctgtctactcctttagatattcttaaatattatttttgttgtgtgctcttaaagttatacttgcagttttaactgaagttgctgtcagaaacatccacagaaatctgttgcagcatatgttgttaaaatgtggtttgcaacggtcattgtacctctctgccctccctaccaaaagcccatatgagacatttctttaaaatttggagccaagatcagcttgatcttactgaagctgctg

SEQ ID NO: 136838 - DNA, 1039 bp, Homo sapiens
tttttactttgctggagaattcttcacaaaataagtcatcaagagcatcttttaaattttaagtttccttagtatatttaagtatgattttctatacacacaactttcttggaatgaatctatttcaatataattttttaaaaaaacctgttaccgtataattttagaaactcttttccacctaatagaaactggttatacatagatgaacaaggtaacttatttcaacacagaaaagcagtgacattttaaaagtatagctttttattgctttgtggtgacctcatcttacattatgtgaaaaatgcttcaattgattatttctttttccctcctaccaggaaataataaactttacatgtttggcagtaacaactggggtcagttaggattaggatcaaagtcagccatcagcaagccaacatgtgtcaaaggtttgggatctttttatcttttcacaaactgtataaagtatttttatgttgactgtgtagttctttaatgtcataaataataaagcttttagttctttattttctgacatttgcttgaatattattagcatttaacttatcttttatatgatattcagaactgcttttatatgttagggtctaaaaatcagattgattttaaatccagggaccacaaaggaagtaatgattttacagtattgcatttgaatatcccccatctttttttgtttgtttgttagtttgtaaaactacttacatattactgttattgtatatacagagaacaaacatatgttagaattttgagcttttctcatttaatacagttgtggacattatgcttctatttggttgctggttttataaaacatacttatcctgctttatatagtgactaggtgaagtaaacgaaacatcgagactagggattgattagtactagtgtaaaagaacaacaggacaaaatatttgaaatcaggagtgttccagaaaatattagatatataatacccttacaaagctttctggatgttatatgcaaaacctctgtttgggtataacct

SEQ ID NO: 136839 - DNA, 1588 bp, Homo sapiens
gcagaaacgtgactgatgggcagcggggcacccataaacttcccatagccaggtgcaggcatacctgcaaatgtaacgcccaactgtgtacaaagcagaaatctaaatgccagggcggactgggagaggttcccgtgacctctgacccggcctctaaattctcccattccctccccactgtcctgccgcgccccgtgtcgcctcgcctggcctcgcctggcctcgcctccctcctccgctgggggtctaagcctgcgcagtattgcgaacgcgggcggcgtttcccgcatgcgcagtcactgcccggcccggctttttcagtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatca

SEQ ID NO: 136840 - DNA, 1703 bp, Homo sapiens
aaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaat

SEQ ID NO: 136841 - DNA, 1032 bp, Homo sapiens
ttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctggg

SEQ ID NO: 136842 - DNA, 2109 bp, Homo sapiens
tcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgact

SEQ ID NO: 136843 - DNA, 1841 bp, Homo sapiens
gttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgt

SEQ ID NO: 136844 - DNA, 1086 bp, Homo sapiens
tgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagaga

SEQ ID NO: 136845 - DNA, 1102 bp, Homo sapiens
tgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataa

SEQ ID NO: 136846 - DNA, 2028 bp, Homo sapiens
acaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatt

SEQ ID NO: 136847 - DNA, 1564 bp, Homo sapiens
aagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccag

SEQ ID NO: 136848 - DNA, 1626 bp, Homo sapiens
gaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccct

SEQ ID NO: 136849 - DNA, 1039 bp, Homo sapiens
ttaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaatttt

SEQ ID NO: 136850 - DNA, 1050 bp, Homo sapiens
gctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgca

SEQ ID NO: 136851 - DNA, 2071 bp, Homo sapiens
tctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaag

SEQ ID NO: 136852 - DNA, 1041 bp, Homo sapiens
tactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtg

SEQ ID NO: 136853 - DNA, 1050 bp, Homo sapiens
tggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgc

SEQ ID NO: 136854 - DNA, 1059 bp, Homo sapiens
agattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttact

SEQ ID NO: 136855 - DNA, 1050 bp, Homo sapiens
actcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacacctta

SEQ ID NO: 136856 - DNA, 1020 bp, Homo sapiens
accattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggc

SEQ ID NO: 136857 - DNA, 2460 bp, Homo sapiens
ttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattacaagcagctgtgttctggttctgttctttggttcttatgaaagttttaaaacacatttcttttccatcttgctcttcaggacatcgcaggcaggtggaccatctcacacactgacacacctctccatgtgtgctcccaccccactaaaatagcatcagcagcagagaagctaaagggttaggtttttttaattattgttatggacacttcagaaactttaaccatttatcatgaacagaatacattgttgtctgtggaaatagagccttcatatcatttcaggcctctgaaatccttgggcctgaaatccgtgaaataaatacaaagatttcagctgagtttttaaagtctggatttcattttgttaaaaaggaaatgagcctctattctttccttcatcgcttctaatg

SEQ ID NO: 136858 - DNA, 1045 bp, Homo sapiens
gtgctgggattacaggcaagagccaccatgctcggcctacaagtggatttttaaggaaaaaaagaggcaggttcctaaattgcttaccaagaatttacattaaaataacataaattataggttgactatacattgttctttgtatcacaaattcgaggagcataagcataatgaaggaggtaggtagacaggtacaaatgactttaaaccagtgtcccccagcatggttgtggggtgtgggatgactgatgtcccatactaacgtctctgtgagcctgctaaactttgcacatactcagactgcttgagctatttttcttttttcaaaagctttaagaaaaaagttggaaaatcactgagttagattatgacactaatgagaggaatcagagctgcacaaaatgtagtctgaatcagcagtgtgggcaccacccgggagcttgttataactgcagaatctcaacccagagattctgtcccacccagaatctgaatctgcattttaacaagccctcctggggattcgtagtcacaaaaatttgagaagtactggtttaggatttaggccactggtttccaaacttagctgtactttggaatcacctgggagttggggaataggctgggcattgggatttttaaaggctccccagaggattctgatgtgcagccaaggttgaaaacactgatttaggccacagcctgagccctaatatgattgttgtcctaaaaatatgggctgttttgccattagagaaccaggtttatagtataagtcaatcagctaggaccctataccactaaggaaaggtgacagcagcccacccaacatcctcctagcatatgaaagctagtacatagtgaatggagaatggttattctgggaagtgggtggggcaagtgtcaagggcattgagaattcctttccagcagatggtatcacttatcaactggtttaggacagcaatgagatctcatttatatgcagcaattttcctcttcaccagggattaactccatagaaacactcagactagcctgcctg

SEQ ID NO: 136859 - DNA, 1045 bp, Homo sapiens
atatattgcctttattatgttgaggcacattccttctatgcctaatttgttgagagtttttatcataaaaggataattcaatagcaaaaagacaaaaaaccttattcacgaatgggctaagaacctgaatagacattttttccaaagaaaacacacaaatgacctacacatatatatatgtaaaggtgtgcaacatcactaatgattagggaaatgcaaatcaaaaccaaagtggtatatcagcttatgctgttaggataccaaaaaagacaagatataacaaatgttggtgagaatgtggagaaaaggaaaccctagcatactgttggtaggaatgtaaattaatacagccattatggaaaaaagtatgctggttcttcaaaaaattaaacatggaaccaccataaaatctagtaatcccacttctgggtatatatccaaaggagatgaaattggtatctcaaacaggcatctgcacccctgtgttcattgcagcattattcatgatagtcaatatatggaaacaacctaagtgtccattgacaaatgaataaagaaaatgtgattgatatatgtgtatgtgtatagatattccattgtgtatatagcatatattcatatttatatatcatatttatattattcagccataaaaaagaatgaaatcctgccatttgcaacaacatggatgaacctggaagacattatgataagtgaaataatcagacatagaaagacaaatactgcatggtctcaacttacatgtggactctaaagaagtcaaacacatagaggcaaagagtagaatggtggttaccagagtacgaggttgggggaatggggacatgttagtcacagggtacaatctataagatgacaagttcaggggatctaatgtacagcatgggtggtgatggatgtgttaatctgactgtggtaatcattacataatgtatacatatgtcaaatcgtgagtattttcccatgctatcatttcccatcatcatattttaagttatagtgaacattaataagcacttactct

SEQ ID NO: 136860 - DNA, 1073 bp, Homo sapiens
caaagacctcttgctttgaggctgttggcgtgctacaaggactcgaaagttatttgttcaacggatgacttctgttttctggaggcaaactgaattccgggcaggtggctcagcacctccagcctgttccagatcgggacagggaaggtgcctggggcaatcagtgaggtttccaaccttccttaggcctgggccagcccgctcccctcccatgtgaccccaggcaaccattttaatttttttacagccaagcgtagtggagaactggctgcgcgccggttgccagggacgcggcagccagcttggcggggctggggtgaaagaggacgctgcgtgggggagggctccgcggcttctgactggctggagcatcaggattcatttgcataatattttctgacggcttctgattggctgaagccagaggggcggtggtggggtgattccaagggcccagagctctggccggcggaccttttccttctggagtttccccggcgggtgtgagttgttgcggggtctgggggagctgggaggcccggtttgggaagttttgcaggcaggtgcatgagccatctttctctgaaagtgtttaagaaatgttcaagaacagcggccagagtcaagaaactgggggatgaagggttatctcgagactagacggaaggaaacgtatcaggggaggggtggaggccagaaggaaggagttaggtaggggccctctcccaagctggcgtttttgctgggtggaatccttttgctagatcccttggatttccgttttccgtgtgttatcacactgttggaactgggaagaagagaaaaagaggcaagattttggcatttagtaagttaagtctgaataccgagttttcatccgggtgcatacgtacttaaaataccaaatgggtccaggaagggggacaaagtacgctttaatttatgagaagatcagctactagaaactgtatatctgtttttctcgagttttcttcttgcagtgctctttcaatctcattggacatattttatattattttcctgcttaagcactgggggttgggtggaaggat

SEQ ID NO: 136861 - DNA, 1343 bp, Homo sapiens
tcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagcaaaagtaaattttgtgttctctctggtatttcatggtggtggatattcatctgtgcaagtatttagctttgtttgggaactaggtactgacaaaatttacttccaaactttatttctaattcagtaccaagataagaccatacatctcaacaaaaagttcagaaatatttaaaatatttgggaaggtacatatattgtatctttcaaccaatttggctaacttattggagtgcgtaattaacattttgaattttttaagaagctcaagcacaagctaaagtgttttgaggcataaaaacaaggctgaaatttcacttggttactgagaagtgaaaattagaagggaagaccagctaatcctagtg

SEQ ID NO: 136862 - DNA, 1120 bp, Homo sapiens
cagtctccaaccccctacccaagacttactgaatcagaatctgaattttaacaagatcctcaggaaattcctatgtgcaataatgtttgagatgcactgatccaaaggattccaggtctgatcatatcacatacacgctcagaactacatcctgatcttatcttaacttcccatcctcagcttttatcattccccaccataccttggaatcttatgctctagtcttatgattgcatcatgtccttccatccatcctcacactgtatcctccagcagcaatgccctaaccatcctccatgcctatcaaaaattctcatggtcttcatgcccagatatcttctttgtgaagcctgacccaatcccccaatagaaatgtgtcattactattcattagtcactgattgacttgattatgtttacatgattacatctagcataacggttaaaaagatgaaattagaccctgatcatcctcactttgaaccccagtttcaccagttttaatctatgtgtggtagattagatcactattttcagtttttcactctctttctctattcaaattatacccacagccttctctatgtgactttgcagtttctcctacttgattgggtgtaaaatatttccctgcccattgacgttggtcttggttatgtgacttgaattggttaatagactatgggtgatagtgacaatgtgtgagttctgagcctaggccttaaaaggccttaaatggtattatatgtctctagttgtcccttggtgcttctactgtaagtatgatcaggacatgcccaggttagctattaggttgaaggaagatgagatatacatgaaaccgatttgaactcaacctgcaaccaagccaaggtgacacacgtcttgaagcagaactgccccagtagacccacagacccatgctaaataaaaaacaagatgacttatggtatgtcactgagctttgtggtggttggttgcaaagcattatttgtgggactacatagctgatacactatgcctctgagccacaattttcccatctgtatcatagatatgtaaatatatacctcatattgctgttgggatgattaaaatgtgttaatgtatgttaaccgag

SEQ ID NO: 136863 - DNA, 1057 bp, Homo sapiens
ctgcttcatgatactctgtgtttacagccctttgagcagcctccagcccagtgctcatctaggagttgtcaggaaccacctgtgtcagattattctggagcactgggtaaacatatacattcttaagttccacctcagattcacacctctcaatcataatggagagggagttgtaatgtgcattttagtaggtccccttaagtttgagatttcctggtcttgacttcattgaggtctttgtgaagtttaatatggtcaaactgcttccgctcaccaagcaatgtgccttctagtgtcatacttggagaaactagattttattatcacatgtgtttgtattttattttattacttggactctctgacatctcccttattaaaatgttcctgtatcatgcaactagtctagaccaggggttagcaaacgttttctgtaaatgttcaggtagtaaatattttccactttatgggttatatagtctctgttatcactactaaactctgttattgcaatgcaaaagcagccacagacaatatttaaacaaatggacctggctatgttccaatgaaactttatttgcaaaaataggtggctgataagatttggcctatgggctatagtttgcagacccctaatctaagccattagacaactaaatatgtatcaccttgtatcatttccttgtatggaaccgctctgtcttgtaatagtaaaatagttacaaaaaaaatggaatctcattcaagttattttaatggttctcaaacttgaatgtatatgataattcccttgaagggtttattgaagtatggattgctaggcccacccacagaatttctgacacagtagatctggagtaaagcccaagaatttgcacttccaacaagttcccagatgatactgatgatgctggtccagggaccacattttaagaaccactgccttgagtaaagtggaacaggttattgataggatttatgtgaaaattaggagttcagccatgaggccaagaacacaggatcagtttcgcaagggtccacccagagattggaagga

SEQ ID NO: 136864 - DNA, 1015 bp, Homo sapiens
gatggggtttcggcatgttggccaagatggtcttgatctcctgacctcgtgatccacctgcctcagcctcccaaagtgctgggattacaggggtgagccaccgagcctggcctcaggtagttcttcacagcaatgagagaatggactaatgcagttgctataagtctcatttgctataagtctcattgctgttgtgagcatggagacagctctatcctggagccctgggcttggggcacccagagaagacaggagggcttcataccaagggtggccttcccagcaccacatccagccctcctgctcactgcagggcagctgtgacacattcatccaatgaaagggtcaccaggggaaggtcaccattgagcagaaggtgagatgggggctgggtctctcacagtgcctcctttctccagcctcctcagcagagactatagggccaggaggaggtgacgtggtggcaactcagacctagtcccactgatcacatgatgctggggagcactgaatggttgttggagcatctggacctatgacaggaccttgtgacttagccctaggagggctgtgcccatgcttctgcccctttgcctgtcgatgatggagaactgtccagtgatcgcctgcacagaggtcggtctgccatcctcttgcaagattaatgcctgtagtcccactctctgctgcaggtgctgtcctctataggagccactggccacatatggctttttaaattgaaatataaattaagagtaaatagaacgaaacaatcagtttctcagtcctactggccacatttcaagtgttcagtagggacctgcggctgggaggccactatatcgagtagcacagatctagaccatttccattatcatagaaagttttgttgtatagtgctgagttagaggatgggacaggctgtttgacatttacttgctgatgctcacagtaaactggccaccccaggggtaaggcttgtggggtggggcagtgtgccatcagagaattctac

SEQ ID NO: 136865 - DNA, 2210 bp, Homo sapiens
tctgactgggcagctgactagcccatcattcccatttttttttatctttttttttctttttaagagatcagggtctcactgtgttgcccaggctggagcacagtgagtattcacaggcaagatcccactactgatcagcacgggagttttgacctgctccgtttccaacctgggccagttcaccctttcttaggcaacctcgtggtcccccgcccctgggaggtcaccatatagatgctgaacttagtgtggacacttgatcagcatagcgtgctacagcccagaagtccttggctcaagtgatcctcccacctcagcctccggagtagccaggaccacaggcatgcaccactatgcctgacccatcattgccattttacagatgggcaattctaggtttagagaggtaaagtaattttcacaaagtcaaaatgtaagccaagatttttctctctcttttttttttttttggctgagcacagggtactttattgatggtatatgacaaggtggggctccctaggcccctcccctcttcaaggggtctacatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaaccatgtagttcaggtcaatgaaggggtcattgatggcaacaatatccactttaccagagttaaaagcagccctggtgaccaggcgcccagtacgaccaaatctgttgactccgaccttcaccttccccatggtgtctcagggatgtggtttggctgacgatgcaaaagaagatgcggctgactgtagaacaggaggagcagagagccgagccaagatttttctgacttacctgtctttggccttaaccactacactgtgacatttatgaatatgaaactttcagctcaccagcagtggtatcaaaaggttaagaaatgagtttaaaaggtggggagaggcagtggtaagggagaagaaagtattgctttatgcccctgaaaatacttctcatatccattagaaggccgttctccctgtttcaatggtctattgctgtatagcaaaccaccctaaaacgtggaggcatatgtaggggagaaaagatttcttttctcattcatcactgggttcatggatgaggcacctaaaacaagatcgattaacaagagaaaagcatacaaatgtatttcatatacgttttacgtgacatgagagtactcagaaatgaaaacccaaagaaatgggtaaacttgcaaatttttatgcttaggtttgatgacgaggt

SEQ ID NO: 136866 - DNA, 1038 bp, Homo sapiens
ttttaactctggtaaagtggatattgttgccatcaatgaccccttcattgacctgaactacatggtttacatgttccaatatgactccacccatagcaaattccatggcaccgtcaaggctgagaatgggaagcttgtcatcaatggaaatcccatcaccatcttccaggagcgagatccctccaaaatcaagtggggcgatgctggcgctgagtacgtcatggagtccactggcgtcttcaccaccatgtagaaggctgggcctcatttgcaggggggagccaaaagggtcatcatctctgccccctctgctgatgccccaatgtttgtcatgggtgtgaaccatgagaagtatgacaacaacctcaagattgtcggcagtgccttctgcaccaccaactgcttagcacccctggccaaggtcatccatgacaactttggtatcgtggaaggactcatgaccatagtccacgccatcactgccacccagaagactgtggatggcccctccgggaaactgtggcgtgatggccacggggctctccagaacatcatccctgcctctactggcactgcgaaggctatgggcaaggtcatccctgagctgaacgggaagctcactggcatggccttctgtgtccccactgccgtgtcagtggtggacctgacctgccgtctggaaaaacctgccaaatatgatgacaccaagaaggtggtgaagcaggcatcggagggccccctcaagggcatcctgggctacactgagcaccaggtggtctcctccgacttcaacagcaacacccactcttccaccttcaatgctggggctgtcattgccctcaacaaccactttttcaagctcatttcctggtatgacaatgaatttggctacagcaacaggatggtggacctcatggcccacatggcctccaaggagtaagacccctggaccaccagccccagtaagagcacaagaggaagagagagaccctcactgctggggagtccctgccacactcagtcccccaccacactgaa

SEQ ID NO: 136867 - DNA, 1016 bp, Homo sapiens
gtatggatgggactggggccggggaaggaggctggagtcaggaggagaggcaccacccaggccttactcttcatatgggtggaaccatcccatgaacaagtgggatgaggaagcctgaggagcttttggccaagcttagcctctgggggtgcccaacactgggcacggatagggctggggcacagacccaatattccagtacctccaagtcttttgtccggcacccaggctaggggccctgaagatgcttcactgtccagcgggatggggttggggaaatatttttgttctcttcagctcagtagccttcttccttcctttcatcaccttgtctaagactggccgggtcttttctcaaggtcaccccaggaaccagggttccttgggttctgtcgccagctctgggcacctctccaccatgggccacctggctctttcattttcttacttccaacttccaccttctcttctgcagcattgagctgcttttctcagcctctctggacttaaagcaacttggcccaaaggctgccagttgccctttctcaaccctccaatgcttctgtgccctctaccagggatggggctgtggaatccagagcacacccggttgccttccctaaatttccattcaccagcaaagatgagtttattttccactgtcaggaattcagagtttgaatgattttaccactgctctgttcttggtgcagctgggattctatttatcactgggttaggaatttcacttcctgccttttccatcccagaagaattctctcccctcccctcccttcctcttctctctttcccccttctctcctttcctcttttcccttctcctctgcctgcttttccatccctctccccttctcctctccttccccaccctcctcttcccccctttccattttgttccccttctccattctctcccttttttcttcccccctctcccctgcccttttctgtctcctctcctttctccccttccctttttctctcttccccctcct

SEQ ID NO: 136868 - DNA, 1256 bp, Homo sapiens
agaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattgaagtaccttgtgtcccatgtattcctaaagcattattgttgtccctgattcttcttaaatggtgctggtgatgtattccctatagataactttagagcaatttatagtctctggaaaccaaagcagactggaggattttggaggagttatactcagaatataatttggagtcctattctgaaagcccaattcttggacatatttc

SEQ ID NO: 136869 - DNA, 1019 bp, Homo sapiens
cacttgagcccaggagatcgaggctgcagtgagccatgatccgccccactgcactccagcctggacagtggagtgagaccctgtccacccccacccccacccccgcaaaaaaaggatagatttgggtttgagatttaggcctgaaatagtctcttcatctgccctgtaaagggttagtcatcaaaataacagtgattcattgcttgacgttgagccactcactgtagctcagtttccctatctgtgcagtggcggtgactgtgcacacctcctggatgaaatactgtgcttaggaggctcagtacccaaggtgcacatgtgcccagctttgcctgttgcttttaaaggagacaactgctttataagcaagtgtggcttgcatgagcataattctattgcgcctctcttcctaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacaggtatgacaaagttcaagaaatggtcttattcaaaaattagatgataactcgatacaatagatgattggaatttgactaggcagaaatcacaaaggctgaaactgtaaagcttttaggagagcagccgagtgtttgaacttttgtgtggtttgactttgttctagtgaagctaagtcatctattcaccctaatgttttaaaagatttcctaaagttattcccattttccacacatgcattcttaacttaggtatggctcataggtttacatcttgagtctgggaaaaatgactcaaaccttccatacatgaaattatttggacaggtttatggtgttaggtcatcagataacccattacttaagccctgggcattacaaagtgcctaaagcagaagcacaaggttttcatgagtgtcaggcacctgcagttaaagtccttatcaggcacttcctgccaaag

SEQ ID NO: 136870 - DNA, 1070 bp, Homo sapiens
tcctgaagcaacagggttaccggccagggttaccagcgtgcagccttaggttcacagggggagcatctagaacattctagttagtgttcaagtgagtgatcacctttgactgatgtgtcttagaaagggcataaaagaattttcagaactcacctcacgtttatgggtggctcaaatgctgcctattttaggttatagatgagttatttaagagttgtcacaaaggagagcctgctgtgacccatcaagctccccccttgccaagtggaacatgtgttgggctaccccacatgttctggctttccccccagtcttcagaacctgacagctctctgctggccatgactgctaggaaaacagtgtaacctgttgtctggtggcagatactgttccatgtgtttgaaaactttcttaatcaaggtaataaaacatggactaaattactgctctgcttactgggagcggttcattttaatgttttaacacgccaaagaagtgagattaataacagtgattctcatgcaaactgttgatgcggaacacattctgcaaagggggaagggaaggattgtcttacttagttcttgaaatgcgtaggttgtggtatgtggtgtattagattcctgtcattaacttaagtaaatatgaaaatatattgattcagccccaagtggggcggagagtgaagcaaaaagaaggtagggttattggaagcgttgatgtcatttgttgatgagtatgataccaacagaggcactgccgcccaggctccaactccgggtctttccaaggggcgtgaggaccagcctaaactcctgggcatcctcctctctgtgaagttgagaaacgttctccagctcatttaattgttcattatgccttgattggccttgcttttatctaaacttgtgtcgtcatccactactacctattggatgaatcgattgagtgaggaggatgtccttgtacttattcatgcgttgtttgaaacattagcaaccaaatccctctgtactcactgtgccaggcactgagctaagggcttgtgtgggtctctaattacagtttct

SEQ ID NO: 136871 - DNA, 1044 bp, Homo sapiens
cctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtacctcttgaccccggcttccctctggggcctgtgcgaacacatccccgcctgcctgcttcccagcttgaggggacaaagctttccttttcctggactcctcccccacaccacacgtcactcccctgtcctagaggagcatgtcttctgggtggcagcgaagtttcaaactagtaagaatgaaatcccttcccccaaaccctcctttgacaggcaccccccacccccaaaaaaagataaggaataaagtgcctctctccacgcaggtttgtcacgtggggaggaggaggggaagcagcggctgttagaaggacacgggcttaaccgtgtgcgctgcttggttttatgataggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggtgtgtccctgtgggcgctccctggggctgcaggctggggggcggggcctgcggactgtggtgggcgaggggagggacatggagagcagagctcagccccctccacatcggggctgggccggtgctccaacaggatgtttgtgttagccccactctcactgctgtctctttggtggcttgttcaatcgcggtgtggaaagaaaggcctctctgatgttcagttcgtgttcaggcaggtaggctgctacggcatcctccagtctcgctaacttatctctgatataaaatctgaca

SEQ ID NO: 136872 - DNA, 1027 bp, Homo sapiens
gaagggagaaggagaaagtcaggagtgtgacatgcacctcactctgctttacttgccactcgtcttcaatgtaccctccctctggaaagttctgtttctgagggttttgtgctaaccatgtgtgaggaccccagtctccaaagaagcagctgtcaatagcagattaccttgggcatggtggtcccacgcactccccagatcctgccttctcatggcgaccttcgggcttcattaatgccctcttgtctcccctcccccaggcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaaggtgagccctgtctgcttcgcccgcctgccggggggtgggcctttgcatgcggccacagtggatggacaggagatgtggatgtgcggcgcgctgcccccgtagacagagtcggtgaggggaagccgtgggggcgcagcagtggagcggacctctccattcccacactgcctcgtgaggttcccaccctggagcccccggggggagccgcccacacctcccctcccccaaagccagaacccagatggccaaagatgattaggccccttcccaaaagcagagaccagtgaccacaccccccctcccccaccccattagtgatgcgtaagacagtttgttcccccccggggggctttttgattaatttgtagttatttctccattagatgactggcctgagagggaaatgacaaacagttcctctaaccacttagaagacccacattatagtgagctgaccaacctgaaggtgtgcattgaattaacagggctccatcctaaaaaac

SEQ ID NO: 136873 - DNA, 1173 bp, Homo sapiens
ttgttgccacggtgacttgtaaatgttgccatggcgatgcttccaggaggtattgcaatggcatagccatggtaaattatgggatgtatgtgctgtgccttataggaccatgatgcaaggagaaagtggtagacggtgtaggactcagccatgttcacatctgcctagatctcatgaccaaaggcacatggcattccactcacagaagggctgtaagtagttgcaatggaagaggaccctgatggttaggacccctatctatcccttcatctctgtctatgcacccatctcctttgccctcaagagtaatttctgtgggtactggtaagaatagccccatttgagggaggtccaagtgaagtgtacaggaaagtgacctggagcctctccctcatagctgtttgccatacgtatcttcggcagtcaaggtgggtgttctttgggattattactggcccatggagggaaaccctagcataaggtttgggggccttcactgaggggaattgggatgtttgccttgagaggctcaggggttgaaggaaggacaataggcctcatttgcggaaagatctcgtttgcggaaagatcttcttgagagcggacaagaagcatctacactgcgtgtgggcaggcatgattgcagtgaaccccagatgcagcagtggagggctcccgataatagttctggactattcaggaggcagaagggggccctgtccggctgaacggggaatggtggggacttggaggaggcatgtgtgtttcgcaccccttatcctagcctgctggcttccccatgaatggggagcagaaggtggtgtgtgcaggggagccctccccacccccactgggcagcttttcctagatggggagccccagagaagacagatggcaagacctccccatatctaatgggggtgctccctagcagagagactaggtccccagttagtcactgcctgttgatgccagtctgtgaaataagtgattacaagtcttctaggtggttttctgtggacaaaatatactggcagtttgggcataaggccaggtaggtgagatataaactcatttcactattaggaagtttgcagtgaaggtcaaaactccaatggaaaactttctccctgagaaagatgccttagacttggttgagattgttacaaatac

SEQ ID NO: 136874 - DNA, 1108 bp, Homo sapiens
ccaacaggctgtgttcttggagcacccaggacagggccctgcaagccataagtcaccacgtagtgctcctcaggtaatgagccatggcagggagagcagaagaagagttgggggaaggtgaaggctgctttttaaatactagggccaaggaagagctggggcaccataggtttgtggttgatcaagaggaggaacctagaggaaatgttgtccttgctgctgccactgccatctcatccagggtacagcatgcgctggatccgtttggcttcaaattcactgagctatctcggccatcacgtctcttcatgggtgtcactgtggcccagagccaagctgtgagcatatggaaactggggtggggatttggggcaggcaggggtcacaaagagggtacaggatgcctccccgaagcctctcccctccactcctacagcaccagtagcttctgagatggcaggtgccgcctgtgcggcctcagctgcctgcgtgtgggtgcatcttgttgggagggcttgtttaaaaaaactgaattaactggacaacaccgtggttaggattttcattgactcttagtgatagtatgggttgctgagtttttcatttagaaattgaacaaatgagttaggagtgtccccaaactcctaaggaatgataagtggcattttgaagatggggtagggaacacggaggtgttgggcccttcctttttgtttttagttttattatttttattgattgatttacttttgttgatacatattagatgtgcatattagcccttccttcttgaatttgggtgtctgtctcccttggtagccacttggcttgtgtggacctaggactcactcagtggcaatgcctgagcgggagctggagaaagcgttgagtgaaagtgaaagggtttcatgggacttcttggctcaggaaacttctcttccaggacagcagcccctatgtactttgtaaactactttgagtttgggcagacagatgactaccaatgcctctgctgctggagagggtagaagttataacatggttggcctctgctagaggtgatgttgcctgcagagggagtagatgtcatgggcagtcctcaaaaatc

SEQ ID NO: 136875 - DNA, 1182 bp, Homo sapiens
gataacagtctaatataacgcagtgtagcagaggtatggcagtaggaaattaggtgcagggacaggttatattttgtagcagtggaatgacacttcccagccatctcctgccccacccctgtggtgacagtctgatgtggaatgaagagtccttatattctccctccaaaggcatagatgttgttgaagtaggatgaacatggtgaagtcaccataaagatgagcgttacgatttaccgtggggggtgggggagaattggccacagaatcccaaggcagcctggcatgcatgagggggctcttcccaccggacagagggcagcttgcattttggagggcaagtgatgtgaagagaaggctagtatcttcctcagtacactccctttggtccttacagcaggtcccccaccccaccaacagggttgactttgggatttgctcacgagtcttctagggtgctaagatgtgttggcagcaagtggaggtcttcctctttatttcttaaatatgcaagcttgaagctttaggtctgcttgcaacatgagaaacctcactgggcgaaggggaattagggtgtctgggtgaactaactggaggagtaggtgcaaagtcctcctgacacaggacacttggaagtgttgggtatgtttgagagctccccaccatgggccgtcggaggtttgacattcacaacacagttcatcggtgcctgacagagtttgggaagaatgtgtgatcagggagagtgtgcttcttgatactcggagcgcacacccctccctccacttccagctcatccctgggagcagactaaggccacctgccaggatcctgggtaagctaaaccaggactgatttgttgtaagtcattgctgaagaaagtagtttctgctgctaataggtggtggccttactcaagtggcagggactcaatgtacctgaagttgctcactcttcctcaaagagtggctacagggcagtgggaggtccaagccactcttgggtgaagtggcaaagaaagccttcctcctccctgatgattgctgccaactcgcagcccccactctgagttgcctcaacaccagctcttgggaaggttgtcagagggacctgggagaagtgggcaaggccgagttgatggggaaggtgcttctaaaagagggagtgccatacataagaatc

SEQ ID NO: 136876 - DNA, 1091 bp, Homo sapiens
cagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggc

SEQ ID NO: 136877 - DNA, 1279 bp, Homo sapiens
ttgaactagttggcagtgtctttgggtgctgctgccttgaaggagtatcccagtaacacccatgttgttcttctgcaaaggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagc

SEQ ID NO: 136878 - DNA, 1060 bp, Homo sapiens
agacagcaggcacagcctgccttccccatctgcatcctttatgaatcacctagaaagaggccttctctagcgccctgtttggctctcctttactgaacctcctgggattttttttctttccttttaacagactagacgcttgaagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtt

SEQ ID NO: 136879 - DNA, 1073 bp, Homo sapiens
gacttaggatggccaagaatgtggacctgcctctggaccgtcctggggcaagctgggtgtaaaaattcactcctctcccccatgagtcccaaggttgaagccttccaagccctggcacctgcctggtcctccttgggttttggaagatcatttagggctgactttggtctctgggtgtacagcctacaggatatctgcaaatctacttcattctctcctgtcccccccaccctcagcacctcccctccctaagtctactctctaagttttaacatggacttctacatctagttgggtttccgatggggagctgggagatgcttctggagtgagacatgaacttcggtgccagttctataaattggtctctttttatgacgtgtgccattttctgtaggaatgttgcttgcaaaacgagtttcgccttggaggaaaggcggaaagataaacaagcctgcaacgccaaaacactggcagtctttccctccttccagctctcttaaagcagccgggctgtatttccaggattagacttgtgcatgtgaggagggactcgcgttggctttttttcccccaagcaaatgcaaattagagaaaaataattttctttcaacgatatgcaatgtattagtcacttgttatcgtgctccgaggcaggcctcatttgcgcgtctgccagctcgctcacatctgctcagcgctgttcggggcattttaaccttggcggtgtcgtgtctagtcccatggatcaaggaggagtaattaagccctgaacagctacaaaaattcgtgggcccccatctataccatagttgttccatggctttgttttgggtgctctgagttccatgactgagtagcagacatgggattcctattgttccttgtaaagaaggtgggtgcccctctccttctctgaccctcatcccagcctttctgggactcccaggctctgcacaatcagtgagagactcgcttgcagattgcaggacccctgcattttacacatcttttatgcattaaaagttcctttgtgcttcctgtgtatactaatgatagctgttgttattagc

SEQ ID NO: 136880 - DNA, 2882 bp, Homo sapiens
gggattaagtccggatgttatgagggctcaatgtggttttcaataaagtctgccagggattgcttcttttatatcaatatgtatttaaaaaaattactagcatgagaagaaaaccagacctgtatggatccaggctggtagtaagctactgtgatcaggtttcctactcgactcccagaggggaagtcagtgtttgattgaagctacacttggttcttgactctcaggggatgcctgctctgaaacaggagccctccctccctttctctcctcctctccccctcctcctccctctttttcccttcttcccctaaaagcctttgtgctgaaagagcttcagtaggcacgaatccctggtccctctctaaagaatgccttacagcctttgctgacattgttttgtgaacagtgggttttaccaggccagcagtttccccccgattttagcgcacgattttaaaggtagtgtatggacaagatgcgccttactgcagtgattgcctcagtgtgtagcctgggctggggcttggaatctagagacgccttaacctttgccctaggggccctcctggagtggggggtgaaggtggggagctcgaggactgattgttttcgaggatctgtttgttttgtccagccaccgaggctgaaggtggagttgggcaagtctgagtgtatgttccagctttgggtctgattttaaacttggtttaattggagaaactcctaggcatttaacagttctgtacaaatgcaaacttgaaatagctcgaggcctacgtcatttaggaaagaataaatgaagtacagaaatgtccaaactatgtaaatcctagcgttgtctgccctcccataaacacatgacaagtgccaaggcatttccagtcaaaacacccatggaagcagcagcctccatcctttgtatttattattttattaacagcattttacacagcatttaacaagcacagcgtgcctgctttgcaccaggactctaagcaggcgaaagggtggaaaatggatggaggtgggggaggagtggttgctagaggacatcaactagagaaatctcatcagatgggtagggaaagcagcaccgggggtttatttctactggccacaaggaagacagacatagtgctttggaggaagaaatcctctctcccatcccaggaggaaagttgtacagctgtgatatgtctggtctcagctttgattccagagggtaaaacagggtatgtttcatgatactctgcccatcggttattggtgattttcaaagaataagtatttgtctgctatcgttattctatatcctggtggaaagtttataacgaaaagtaatgcctttcttaagtcataaaatgagccttgtatgcttatttaattaaaatctatttaaggaccgattaggcgtgtaatttgcactaataatgacgattatggaaatgttcaacttaaccaaaaatcataaaggagacattttgatcagtggggcggccagtaagtatttagtgagttgggcaatttccgaaagacaggaggcattccgctgagggctgcagaaagcacagacctgtctggcctctgtgacatggcatggagaggggcagacctccctgtcccggccccggccccagcccggccagaccccactttgctgagcatggaaaccaaccctgcgagtctccacaacctttattctcgtgatgcttcctcgagcttccagaaggagtaaactctcggagagggctgatgagccacacggaaatctctgcgaaatggcggtgctcttttgctttaacaaacagcgctgacaaacgcatgcttccttggctagccttggctggatcccggaggggtagggggagaaggggtcccttgttccggagaaacctgccagctgctgggcttggtgtgaaggcagcaaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagcagcgctgcgcctcctcagcacttacacaaagcgcgcactatgcaggcccatggacgagctgcagaggtggcggccagtttctggccagcgcatccccagatgagagaaagctccacggcacacccgccctccatccccaacacacatctttatgacttcccaggattggggtggggtgcaggatggtttgtatgttgtggtttagggaacttgtggtgaggcagaggtggcgggagaaggcccacggggccgtgagtgtcaccgtgttggtggggtttggccaggatccgttgaactgggtcctcagctgtttatggctgagtttttaagatttgtgaaaataactttcagccctaagtaagcttgttggaaagaatgtgttattaactgaaagctttctggaaattgcagaggctctgaaggccgttgttcccctctgaaatggccctgttattcagacaagttagagacaggcgggtgctgtgttctgtgcactcgacactgtttccagcttggaaatgcaagtgtgcaggttcagtaccctaaggggggtgtattttggggggaagggaggacagattggcttttgattacccacatcccttaaccttttcttccaagccttcccgttttcaagagcacatttgccttcaactgcagcacgcaaaggtgccgtcctgaagcctgcccacagcaccacctactctgacttcatcaactagatgcccacagcaacaggctttctttgagttcctggtaccccgccaggccctgcagagaggcgccagggtgggagggagagcagttggtggtg

SEQ ID NO: 136881 - DNA, 1050 bp, Homo sapiens
cgcctcccggtgcctccacgggctgctccccccttcccccacctccaaacaattcccacacaattgaaacgtccggggaactcgggcgcggagttcaggcggaacggccaccgttgcctggggtggtgttttcaggtagcttttaacaccgaaatgggaaagggctcctctgggaggaaggggcaaactggggtgggggtgagcacgggagcacacaggccacgctccgctgggtctcggaggggacgaggccgggagagcgcagcgctggtggcaagaggcggcggcagcggctgctgccgctggggtttgacagctttggctgagcggagtgcgaggcgctttatggtaattgcggtcctccactggccttctgggtagcgaggggagtctcggcgcgcggctgggagagccgcccccgccgcccccatcccttcggctctggctctgccggcagccctcgccgccgccgccgcccaagtcggtctccggctcgcccaggacgtgcgcccgggtcgggcgtgcgcagccaactcggcccgagctggggaggggaggccgggggacgaggagggggggcgccacccaagtggtccggggttcggatccagagaggccaaaacgtgccgggccgtgcatcgatgacggccggggaaactcgggcaaacctttcctggggaatcacccctcccgaaaccccgccgcggaggcgccgcagcggagggtgagcggagactggcggagctcaaacttgcgagagctggaggcggcggcgggcgggcggctgtcgcccgagcgctgcgcctgcggggggaggggaggcggctgttgggagggagggaggtagggcgggcgggagggaggacgggcggagggagggggaggaggaagaggagggaaccagggaggggggacgcgttgggatcgcggcgtgcggcggcagacggagcctgggctcccagcggcaaggtgaggcagagctgcgctcctcgctgaacgcgggccgagctcggcggctgcgggggagacgcgcaggagcccagaccgcga

SEQ ID NO: 136882 - DNA, 1084 bp, Homo sapiens
tcgctcggctcccgctggcaaaacaacgccttcccgggccgggccctgggccaggagagtcggggagggtgggacggaggtggggggtgggtgaggcagggcaagccttgcaggtcagctccgccgccggatctcctccggacacggaggagacggggagcgtccattggcccttccctaggtggagtggcaaagtccgagccccgcagccgaccctacgtccctacgtggaggggggcgggtggagtaccggtgccgccatgacctactcccgtcccccgccggaggctagagtagggctgagggggagatgagtgtgtctggtttggagagcgggggcggacactgggaaggctcccaaaacaggttttgccccatctgttttatgaacgacctcttcaggccagaagccggatcccaggggtggcggcccttcgaccttcgaaaggagacccgggcccccagcaggccctctggcttcgcgctctgtcgcctgcagtgggtgggagatgggggtggccgaggcttggctgctcctggccctgagcttcggagccctattttctcctccgcgatctctgcacacaacagtaggcagcctctcacagcagcacgcgcccagctgcagggcctgggagcaggtgttcctgcccggccggagtggcggctccgcgcccctccggtcccagctgcggagctgcgagcggtgcgggggggcgtgcttatggtggtagcagagggacagggacatctcatcggaccgcaggaagggtcctctcggcttacaccgggataccgcagggcccgggtggtcgcctggggcgaggagggatcaggggtgacgcgcggccagccctcgtctggaacagccctggggccagcggaggccgctcggggcggcgcgagggcttccggtccccgtgactgcggcggcggcggcggggcggccgcgaggagcaccctcccctggctgctgccgccgcgcggctctcggaacggcgccccaggagcctctctgcgtctggcagcgccgctttcggcttgcgctgggatgggggccgcagggtggtctcggcccagcccc

SEQ ID NO: 136883 - DNA, 1116 bp, Homo sapiens
tggaaattgacaaggcctgtctccatgtgttgctagaaaagtaagatatattgataagtttcataggtgaggtacagaacagattgtgcagtgtgttcccatttctgaaagtagaccagaggacatgcatatctacagagaaactgggggggaagggggcactcccctgcagtgttggaaatctttaatgcacacacaaatatgtgtctatattcccccctattttgtttttacacaaactgtagcagatggtacacactgctctgtaccttatttttttttccttaactgtagaccttgggggtctttccatatcaatacacagagcagatcttctttattattttaacagctacagaatattccattgtatgcatgtgccatcaatgtcactgctgactctttaggttgtttataatcctatgctgttataaacaaagctgcacttattccagtgtcttaaaataacttcatgactagctgatttttagagtgaacatgaggtaagcctgcagaaattccacatggatggagacacctctttcaagaagtccaggtgtacagggaaacagataaatagggaaccagcaaaggagatgcgaggttaagaaggggcattataaagatgggtgatgcttcaagcaaagaagtataacaaggggcctttcaagaaagggtatggggggtgagggtggaggcagcaaggaaaagcctctaagaaggtgatattttagcaggtatgaaacgatgacttaaaacagtgtgagatcctatgttgggtgctgcgggaacatcaggatggatggacagacactggccttctggaaggttcaactccagcagggaagctgtgctgtttcacaaattggctgcaatattgttagaaagtggttgattctcggccgggcgtggtggctcacgcctgtaatcccagcactttgggaggccgtggctggtggatcacctgaggtcaggagtttgagaccagcctgaccaacatggtgaaaccccgtctctactagaaatacaaaaacattagctgggtgtagtggcgggagcctgtaattccagctacttgggaggctgaggcaggagaatcacttgaacccgggaggc

SEQ ID NO: 136884 - DNA, 1042 bp, Homo sapiens
gaatggcccagtgcgatctgacacctgggacgctttcagggcaacaccaagggcaatgctccagtctgtatttactctcttctgaggagaaactctggcagcagctggaaaataaaacccaaagcaaggaagaagccgaaaagaagaaatactcaaatacgaggcgcattaatcatcggtgtcagatctagagcagaggacaatggctggtttgaagaaagactgaacctaaattatcttggaaactgatcttctctcctccgggttccctgtgcctgcaagcaggggtcccggtgcagccactggcatggaaccgatgggggcatccactggctgaccagcatgctttgtcacaggacaggttagagatgaccaccttctgtctgtggatcatccatagcttctgcttaggaagctacagaagagaaaaggcctctcacagggacctgcaggacaaattcattgcccatcgtgtcctcaggggacatcatttgcatgccaggatgcagtaaggccactgccttcagatccaaataaagcacccaattagcatgaacttgtgcaattggcagagtaatgaagctgaccacaggtgcctggaaagtccgaaatttagttgctagtgttgcaccgtgatggcaggggctgtgacggcatgaataagtctgggctttgggaatgggcagtgagcttccaggcaagcaggcaaattaattatcctctaagcctcagtttccccatctgaaatgggaataataatagtacctttattataggacagttttttttttttgagacagagtcttgcaccgttgcccaggctggagtgcagtggcgctatctcagctcactgcaagctctgcctcctggtttcacaccattctgctgcctcagcctcccgagtagctgggactacaggcgcccaccaccacacatggctaattttttgtatttttagtagagacggggtttcacggtgttagccaggatggtctcgatctcctgacctcgtgatccacccgcctcggcctcccaaagcact

SEQ ID NO: 136885 - DNA, 1085 bp, Homo sapiens
gccaaggtctgaggggcagggcccagtagggtggctgagggcttccatctttatctcaatagtgaaagccactggagcaccctcgctctggctgcaggatcaacccccgccccccttttacctgtctgatcattcttcctcttttgcaatctggccaccctagaatcctggttgttccttaaacacagcaggcagtctcctaccacagggcctttgcactggctttgcctctgcctgcaaaactctcacctcagaaatcttggcttgctcccccggctccgttgagtctttgctcacatctcactttcccaagagacctcccctgagcaccttaatcctgcaaatccttctccccacaccctgccttccaggtgcttctttcctgctcccacttttctttccatggcatacatcactgtccaccatccatggtaattttgtgacctcttacctttattgcttatcgcccatctctctccttctggaatacaagtaccccgaggacaggtatttgttttgtttcctggggtgtgtcgggagcctggagcagcacctggcacccagcagcagtggttatttgcgggtgtggttgtggctggtggctgctgtgggggccatggactgcagaggggtaggagccagaggagggggcccagtgaggaggccattgccatggcgtaggtgagaagctgtgctaggcagtgcagggcgctggatgtgggggaaatggatggactcctaaaactgcgcagagaaaagaaaacggatttggtgaagggtcggtttggggagtgaagggattggagaggtcaagggtgattctcaggtttctggaatgtataaccaggtggttggtggggaccagggagaagaagcagttttaaggggaggaagagagaaggggcattcctgcagggaacatgcatgggccacaatggggaaaggctgtgtctgctccgggcatagcggaaaacccaatttaggctggagtggaagttcctgcagagaaggtgaggaagacagggtgggggcctaggcaacccgttaatgctgccaactccacgctttcactctggaagcctggg

SEQ ID NO: 136886 - DNA, 1332 bp, Homo sapiens
ggcatattaaccaaggagaaaaaagaccatagacatctattttgcacataattatttaacacccaccatacgcctaccaaagctttggacatttatagcaggaacaaaaacaatatcttggacatcataaaactacattttactggggagagaaaaagtacatgagcaataaaaatatataatattgcaggttgtaataaatactcggaagaattaagaagggtgtgaggctacagagagatggaatgttcttttatgtagttagttatttctatctacagcaggtagaacgagtgttcttttagatggtaggttgtgcagtatgagccttgggttgaccgagtaacgtgctcaggcgatatatcaataagctcttgtcacaacactgttgtatcacaaaccacctcaaaacatcagtaagcacttatttcctacatacatgtcagtgggtcacctgtggttcactggtctagaatgtgctcaacagggcttgactccaagtgtggattggatctaaagctgctccacgtgtccctcatcttctacggacaagtgggctacctgggacatgttcttctcatgacaatggcaaaagtgcaagagggtagagtgcaaatgcaatgactcttaagtccgggactcaaaatttgcacactgttacttctgcctacatctattggccagaagaagtcatgtggcctgacatcggtgggatgaagaggcatgctctacctctaaaaggtgtggacacagggggaggtgaagcactgggaagagtaatgcaatctgaaacaggtgtttcaaaccaaaactatgtatctctagctgtgacatttatatatacaaacacatatatcaaatgataaaacgacccttgttgaaaccttcagttttagattaaatttaaataaatccatgcaataattacattaccctccccgagatggtttatgatgtcaccagaggcttctgggtcattgccgccaatctcaggaaacctgggaagatgggccaccggccatcccaatgctgagagacaaaaaggccatgaagggccgggcgcggtggctcacacctgtaatcccagtactttcggaggccgaggcaggcagattacctgaggtcaggagttcgagactggcctggccaacatggtgaaaccctgtctctactaaaaatacaaaagttagccaggtatggtggtacacgcctgtaatcccaggtactcgggaggctgaggtacgagaatcacttgaatccgggagtggaggttgcagtgagccgagtattgtgtcactacacttcagcctgggcgaaagaatgagactcttt

SEQ ID NO: 136887 - DNA, 1010 bp, Homo sapiens
gtttcaccacattggccaggctggtctcaaactcctgacctcgtgatccacccgcctcggcctcccaaagtgctgggattaccggcgtgagccaccacgcctggccaaaagatttgttttttaacatatttgttataacttaagaatcccctctttggcttttgtttcctactccaaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagacctttctaatttcaactcgtgtgggctagaaacagaagagaaaatcgaaagcaagagagagggaaaggcggcagggaggggagagaaaggagaccaggaaacacacacagacacacacacacacacacagacacacagcattcctgctgccatccctccggaagccatgttaaactggtccatacaattgtccctggctgccccctgcagctcgccagtccttctggattttccatcacttggcgcctaaggcgatcattagctgagaatggacaacctcctctacctgccggcagctcagctcgtcatttaccagccaggggaggctggccccatttgctcaacccgagaggggtccttggtttttgcccctgggtgcattggtgcctaattaaactctatccagggcaacgtgcactaaatatacgtaggctgagaggaagctgggaggaaaaagcagtcattacctaggaagagaaagtgaatcttccgagagagaggaggaaggacccctgcgatggtgctttctgtttaccctcagcagagccttggagtgcatgttcacttgggtgctgaaat

SEQ ID NO: 136888 - DNA, 1503 bp, Homo sapiens
gcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcaggtctgtgcctcgctcgcttcccggtgagaacctttaaatcagcctctcggccctccctcctcccggacactgtcccccgcccgctcaggccccggcagggccccgggcgcgctgtgtgcagtctcggggtcctctccccacctgggggttaaacagagtgggggcgcagggaggacctcagggccgtggggggaggcaccgggctccccagccccggctccgcgcctccgcgggagcggagccccgcgccccgcctccgcgcccacgagatggatcaggctaccgtgcggagagcgggctgtaaatatttaaaaagtctctcgcgcgccggcagtaatggctttcgcagtcggaatgtgtgctaggggaagaggaagggcgacgtgtactgtgttgcagggtggggaattgttcctacgcttccccttaggtccggggtgggctgcatgttcaggcttcccgatttcccgccctccgcctctccgccgccgcgtcccacgatagcatcgagaacgccagtcgacagggaacttgagcatagccgggcaacagaggcccggtcgaggtgaccccggagccaccctccccaccggggtctcccaagctcgtgggttgcgaatggtcccagacccctaatccgggtccgcttctcgctgctgcacaggggagggcgggaaacgcacagattggagccccctgagtttgggtggtcgcaaaagcctgggccggggtttctgcagagggggcctggaccctgtttgtgcctttgctaccctccccagccgctcttaaaccttgatccgctctccaggagacccccacccctatctgaatctgaaagtagctttgtggctgctgggaccgaaacctgggaggaggcagcacggagagtttggggcggggagggggtagcctccaggcttagtggaggtcacacgtggacctgaacggggactcttttgcctttctggtgagtgtgggcctgggatctttaaggccaagccctgccggatggtagaggtgggggagggggattcagccttctcggcttggctgggagagacttaatgggcccaccacagggtgtgtgtcgggtgaggttgtcccctttgccagcggccactccctagcggggcggaggggctgagttgcccagagctggggcgggccgggcgccgcgggttcgcgcggaaggttccaggggtgtgggcccagtccggagctgttcgcctgcgccccgccggctctgggacctgccaaagtgtgggtgctggcggcgtgtcaggacgcgccaggctgctctccgcgttcgagcgctgggagctcccgactcctggcagctccgtgcag

SEQ ID NO: 136889 - DNA, 1010 bp, Homo sapiens
cctccagcgccgccaagtcagataaaaagttgcccgaggccctgagagtggaggcaccagctctctgatggccttgtagacgccctgagaacagtccgagctcctcaaacccgctacctttgtcctgggctcaaggagggggcggaaaccagaggggcccggattcttgaagacctcccctggggaccccactgtctgctgggaaggcctcagccaactgtaggcccaagccctacagagaccagctctggcaggaagtcatgccaagagtctgtgtccgcgtccttaggcgtgagaatggggctatgccaggctgggcctggctgcgcacgcctccgcttcgggactcgggcggctgctgctgccttcgttttcgggtcttcgaccgagcctccctggctctctactcccgctttgtcttgctgtcagcttctcgcctgtcctcgccagtctcctaggtcggcgggtcgcgctctgcctctccgagtgcgtctttgcgcacatgtggcggtcttcctgcaacctgggtcagctcggcctcttcccgcggggtacttggctttgcctttggatcgctgcgagtgtccacttcttgcgctctccttctccccacctcgccttaggcagacgcatcccgggcttggcggtcccccaaacagaaatatccccgggtttctggtttagctccaccaaaacaaactcgagggattggggtatccttcacttgcgtttcccgcttctctcagccctaggccgaaactggagggtttttttgttttgttttgttttaatgagacctactttgcagagttgacggggaacatttctgcggcagacttcgaggtctgtggcgctctcccaactttcaagactgtaagccgccaagaaagagaatttgggtacatgattttgccgctgatgtgggctgggacgagggtatccagagtgcacgtgcatgtgcggatcgcagggactctcggtggattagccgccaaaagctggggagcgcc

SEQ ID NO: 136890 - DNA, 1049 bp, Homo sapiens
cctcccccttccacagctgttacctctgccggcaacttggtggtggtggggacccgtccccccgctgaccctggcctcaggctccgagttcaccccagcagttccagggggtgtttttcttcgagacgtgggaagggaggtaaagccttatcggaactgtgaggcttcgtgccagaatccaaggctcgggtactagccagaggatcctcccggcagaaggccatggtcctccctgtcttacaccaggaggtagtgacagtcccggagggaggggctccaggaacaactctgctggcgacttctgttcattccaggaaaacattacagaagggtgaggtgatgggaggcagaaagatcccccctccctcctgcttgccccaatccctgtcagcacttgggcatttgggacttggtgtgtaggttccttctgcagcagagctcacctgcgccttgggcctaatccacccacatgccacaaggatgcttttcctcttggtttggagtacctggtgggtccaggggggaagtgccacccttagtgggttctggaggtacaactcccccatgctgggtcagttctatgcttgtaccaggaggccctcctgggccttggtccttcccagccatccccagccttagcctcctttccccttggccagctgtctcatgccttaaccacacatctgtgctagctgcaaaaggtcccgcctgtatggatctgtaagaggcccagagctcggccccatggttgaggtgggaagatgtgaagcagtttgctagtgcaggaatcatgaagatattgttgatgatggcagagcagttcctggtctccagcattgccttagaatggcttttcctcgtggtagaactttcgctagtgggtttcacaggctcagggcccaatcttgtgaaagtagctacactccccagcccggaaacacataaatacacataggcaaactcccaggaggctgggtgtaggaaccaccaccggggggatctgcagcagccagagaatgtctgcttttcctgtgatggttctgagaagg

SEQ ID NO: 136891 - DNA, 1085 bp, Homo sapiens
agctcctggctgccagagctctggtgggggaggggaaagggaggagaggagccagcgctagcgtaggtagcggggaatcgaagcttcccaggagaaagagttcattcatgagctgtaggaggcctcgcggcccggccaggtggagcctcctgaagccaacacctgtgtattttcctttttggaaacaggcgagcccatcgatcattaccatattttaattgcctttcgcaaaggtcatctctaattatgggttgcgaggagggttggtcaggagtccgtggccctttattatctgtgtgggtgtgtgtgtgtcgccgcagagacaatgcgcccagctcttatagaaatgccaatccgagggtgtccgtgcgcgcctgcgaggcggtcacgacgtgctggatccacgcagaccaggctgcgtgcacaataaaagccgagcaggcggctgagggccgcgcagacccacgggttttctttttagaaacagtggtgcgaagagacttgacaataataacacgcagcaggattaaatcagggcgggaataaggaaatgtattttcgtttctagaaccgcggactgtgtttaacccatccgatcctcccctccccagagcattttgtgcacacgtggagttccgcgcagggacaggcgccgggcacagagtggcttgggactgcccgatgacgttccagggcagccacgttacgttcatattaatctcttcccttaattcggcatggttgtcagttacagtgacgtgaaacagccttaacgatgtctgttttatgggaaacaatacctggctagttgaaaaagagaaagcaaacgttgaggttttttaacttttgaaagtttgcatttccttagtttttatcactgtcagaaacccttgtggcaaaagcctattttaacttcctccgagggagaagagcagtggagaaggtagatggagggtcaggggttcttgggaggatattttggagatggagggaggtggagatcagtgaagagctgtgagtcaggggtggtcagcagccactctgaacttgattttctcaaaggagcctggcacttctgagccccg

SEQ ID NO: 136892 - DNA, 1704 bp, Homo sapiens
tatacttgttagagcgaaaccccaaccagccccgcctttcacagctggcgtccgtagccgggcggaggcacacgaccaggaaagacagacaccctggttggagaccgtcgctcgagactggcagaaagatctgcactcgggaggcaccctcaccccgtgggctccgggacccctcgactagctccatcacccattccgactacccgccctacgctccacctcttgacccgtcatcaccgaccggggggcgggactgcccgacttttcaatcgctgcctaccattggtagaactctccatccgttactttaagtcccgcctatcaggctgtcgcttcccaggttacgtcccttccgtaggccgcggcgtaactggtgattggtggagaaagcggcagctgtcccagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgaggagccgggggccggcaggacgtgcctggggaggtcctgcgccgcggggcttgggggtcgggggcggccgcgggcgagtagctgcgaggcaggtgccgcagtgcggtccgtcagcggcggcctcgcctcagccgcgtccccgtcagcatcttctctggatcggccgtggcggcgcggcctcacgggccgccggggccggggctgggctgcgtagggggcccctgagcctgcctccaccctccactttgagggcggcgcgtccggccggcttcttgcgcctgaaaaggcccttcagagtacggagatgcatttctcagtgaactgggattgagtcgcagcccgctgcgaagaagagaaggcagactttttagctgccactggctgccacgatgtttttgcatttgtatggtgccttcatttctagtggttgtcatcagtaattgctgaaatccctgcccctcccttcccttatgtatatttccggatgcaaaagttgagatggagtcattatttttatatgacttatatttcttaaggcgaatacaaagcacctctcaatagtttgtcagagttccaaattttaaggatttggaaacaggatgtgagtcgcatttttagggtcacatgtcaataaatggtagctttctgagtagaacctagattcctaagcattcagcaagaggtgaagaaatcagctaatacgtggcctcttactgcatatcatgtggtaatgtatttcatttgacagcagtccttagagggcatcatctttgttttgcagggtgatcaacctaaataaattacccaacactaaacaggttgggtgctggatttgatttcagatgaggtggtgccagcgcatcggccttttccattatatatgttgtgttgcacaagtaacgctattactgtgtgagaatgtgggagtgatggggactgagactggaggcacagacagtagtgaacaagaggccaagttgagaacggcttggaggaatgggtgctctgatctcagtgtgtcagtttaaaacctatgggaggccgggcgcggtggttcacgcctgtaatcccggcactttgggaggccgaagcaggcagatcacctgaggtcaggagtttgagacc

SEQ ID NO: 136893 - DNA, 1037 bp, Homo sapiens
gcggaggttgcagtgagccgagatcgcgccattgcactccagcctgggcgatagagccagaccttgtctcagaagcaaaaacaaacatacaaacaaaccaaaaacctatgtgaggtgttgggaggtcctgcttgtggaatggcgatttaattctgcaccagtatgctcttgaaatctgcagatctctgtccctagaggtgcgggggttttgtgtgttaatgatagttacgttgtatccatgccccaaacgttttcgagttctttgtttctttcttctgtttctggctctggaaaggtctttctgatctactgagatactttgagggaattaattttaattcagtttttgaaattttaaaaatattccctttgatcctgtggtttaactgaacatctattgagattccatgttttaatattttgactgatattattttgattcagtgaggtataggcttttttgttttgggtctgagataaaataattgcttctgcacatggtttgaacatgttttccttactagcatagccgagttcatacagaacaagaacctgatcctgtcagcttctgaattgctcagtcttgtcagatgaggttcagttattattttccacaatgactaaatgtgatgtagtggaaaacatctttaagagctctgacttctctattccaggcagaaacaaaaatagaaatcctttaaaacagtgttgccaaactagagggagaactagggacctagagagagaggaagggaactaggattttgaataccatatcatgaggcgtatttgataaaattcagatatttagcctggagaagaaaggccaagggtgaacacatggaatttgaagtgatgtcatgtagaagagggagataggatccatttttttattattattgattccatccaccattcgtagacgataatagcacagtatagtggagttcctagagggaaggacacttagcccagactggggaggctgaggaaaatttcccatgggaggtgcctcccagggctaatgtgttgaaaag

SEQ ID NO: 136894 - DNA, 1032 bp, Homo sapiens
gtaggaccaaaggaggttttttatggttttagttatagaatgggagtgccttgagcgtatttttatgctgaagtgaaagggccagtggagagggaaaaaactggtggtttgaagtgtgacttcattcattcattaactcaacaagtacttattgagcaccaatgtgtcgggctctgttctcagccctggggatagtgtgtgaacaagacgcactgaaatccccgccttcatggagcttgtattctatagggccatcttttgatggctattaccatatagccacctcactcctgatgtgttgtctgtcctagaagagtggcttccttaacaaacagtgaaggaacaaaggtccctaaaaagactgaacacaggattgtcttagtctggaggagggacatccctgccctcatgtctggagggagaggagttacagataggggcttatgcagataaatttgtggtggggagaggaagcaggtagctcaagaaattcctctgttttctctgtgaagctggagatgaggttatctggtgagactgagttggggagtgatagcataggaagttgaaagttaggaagcccatttcagttcagtacaaggaaaaacttttcaaaggactagaatgttaggaaaatggagccagttgctggcaaatgtagttcgtatattgaggtggtgtccccatcactggtagtattgaaatagaggaggggtgactttctgccaggtatccctgagacatgcttatacttataataagcagaagtttggacaaatgaccttcctctgtataggagtccctgactctaaggttttctaaagctctgggcttctgaaggactgttgtacaggcatggaagttgaaactacgaagctggggcaaagttatttggtataggtttgccagaattgaatgagtagggccgtgtctcaaaacaagggtatctccaaatcaaaatatggttttttaaatgtgtatggtacctggggctgggcgcggtggctcacgcctgtaatcccagcacatagg

SEQ ID NO: 136895 - DNA, 1088 bp, Homo sapiens
ataatttagagatttcaagcttcttcctttttagtctgtgcctgggctttgttttttgttttttaaattttggagatatgccactgatttctaattcctgccaaattgccacatgcctctttaagagccatcagtaggaaggtgtctatatcattaggaaaccctgttttgtagttgtacctttgttgatctctttttgagacttttgtttgtttcttgttcttatcaggcagaccctgaaccagaataggttcagagaggctctgatagttgtacttttgttccagcagaatgtgtggacttaaattcttagagtgatactttgaaaaagaatttgttattgtttaggactcagcattttgaccagtcataatttaatacgctaagtcagtggtgaatggggaaacatgtattatatttaataattgtcaaggtaaatgatttatgatgttgataattcatttactgatctgttttcttttcaggtgttttggggaacgagtttagtatattaaaatcaccagggtctgttgttttccgaaatggaaattggcctataccaggagagcggatcccagacgtggctgcattgtccatgggcttctctgtgaaagaagtatgtatatattttttaaatgtttggagctgcttttaagaacatttttactgatttctgctaatagcccaaaaaagcatcaaacgaacgtaggtacgtttggtacagattacaaaagttaaaaagctcatctggaccaggcacagtggctcacgcctgtaatcccggcactctgggaggccgaggtgggaggctcagttgaacccaggaatttgagaccaacctgggcaacatagtgagactcccatctcaaaaataaatgaattaattttttaaaaacccatttgtagttgggaagattttggatgagtgcttcaagcttggcttctgaaacaaatcattagaaatcattaactatataattatttattcatagtagtgaaattctttgtatattagagaatgcatctgtcctactcttaataggatatctactttctggttttttttttttagtataggcgatagattc

SEQ ID NO: 136896 - DNA, 1073 bp, Homo sapiens
tggtcaaatacggaagatgagtggaatttacaaagcacctgaaggaaaaaaaatgccatgagaaacaggtgcaacaaacagaattcatctccttagaactacggagaataggccaatttccaagagatctaaaaatacatacattaaaattgtgaaaaaaagggccaggcatggtggctcacgcctgtaatcccagctttgggaggccaagatgggaggattgcttgaggccaggagtttgagaccagcttggtcaacatagcaagaccctatctctagggggaaaaaaaaagaaagaaagagaaaaaatttgtgaaaaaaaggaaggaacagaaactatgagggagttataagacatttttgatacatggtgctttagctgatacttcaaaatatttcataatttatattgtgattctttaacccatgagttatgtagaagtattttttccaaatgcatgggttttaaaaaagtaatttctaatttttaaatttctaagttcactgcattgtaatactgtggtctatgtgatgctgaagttttgggatttttttttttttcagactttcctgtggtcgagtatagattatttccaagtacacatggcatacttagaaaaaattactgtgcagtagtccacaaggcaaatctcaacaaacaataaagaatcagtgtcatataaactaacttctctgaccacaatgcagttaaatctgaaaataataataaaatgatatcttaaaagggtatttggagcccggcaccatggctcacgcctgtaatcccaacactttgagaggccaaggcgggtgaatcacttgaggcgaggagtccgagaccagcctggccaacatggctaaaccctgtctctactgaaaatacaaaaattagccaggcgtggtggcacgcatctgtagtcccagctactcagtggctgaggcacgagaattacttgaaactgggaggtggaggttgcagtgagctgggattgcgccactgcactccagcctgggtgacagagcgagactccatctgggaaaaaaaaaaaggtatttggatcaacatttctcct

SEQ ID NO: 136897 - DNA, 1608 bp, Homo sapiens
catgcatgtgtaaacatttgttgagctgttaccccaagatttgtatactatattatatgtattttgcactttaataaaaaaattgaaggaaaaaagtaggtcttatcaccattggttatttcaatctaataatatcaacatgtcctaagataaaggcttcaaaaaccttgtgacatacttaacaccttatctaagagtctttaggctatctgaagacaaatgttaaatctcattaaacatttttaaaattttgaaatgaaagatgaattccatttttatttcaattaaattcaatactcagattcctctaacctcttaaatgcaaattaaatactttattgtggaatatgcattcatcgtggcacatttagtcaatattgaaaccaaatgtattgctgcttcaaatacatgaatgaccaccagaaaatggtttgtgctagatatagtgttgtgtccatcaggtttaagttattttccactgaggcatgatgggagatacagacttggcttaccagggggctgtttaatcttctgtgccctcaaaagggcttgtttggaaatgatttcgggcttctaaatttccatagaaagtgctggaaaaaagtttaaggcttctttttaaataccatctgaatgatttttcttcccactttggttcacataataattgcgttcttactcttaaatttcaggcagttccttttagtcttgacagtgttgcaaattccattcactccttattttctgaggaaactcctgttgttttgcagttggctcccagtgaggaagtaagtgataagggttttattcaagacattttaaaaaataagcttttattatttgaaaattatgaaatgtaattttattatgaaaatataaaactaatttatgaacaatgttgtcatacctctgggtattggaactaatctgtagaatttgagcaacttaaaattttctattcttcttacagagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagtaagtgcagttattcaatgaatacatgaatatcattaatttccgtctttttaaaaaatagagacagggtctcactctgttgtccaggctggtcttgaactcctggcctcaagcaatcctgtcttggcctcccaaagtgctgggatcacaggcttgagccactgcatctggcctcccattccttatactacttgaaattttggaaattttgctattttagaaaatgaaagattgtgcacatttactgctggggtagattcttctttagtgtaattttcttatgactctcatgaataaactgatcctttttgtgagttgagctgtggtaaataacatcacattttagcacgagggttgccacctattaattcaaacaagccagaggtcatagatctacttggtgactggtggagctgtgtggatctggtaacttggaagccattgttcactgcctctgctgatttgttgccacatttttctcattcattctggacattgca

SEQ ID NO: 136898 - DNA, 2013 bp, Homo sapiens
ctacttttgactcctgtccttcagtttctccatctgctcatgcgccctcttaaccatgtggcatgccactttcgtggtggcctcccctttttatttgctgtggatgaccagggccatcatcctttattctctgatgtggaaactattcaagggaagtgagcaaactgggccaatggtaggatgtcattgcagagtgccaggatatcctgatgctttgaaggaaaaccactggagaacttggatgctttatcatggttttgccaaaaatatagctattgagtggcagtcactgtgctagggaatggccatcacctttttgttaggaaataatgttttatatgcattttcaattgaagcaaacataccaaatggaagataattatataaattcacttatatgatcaacatttgtaatatcctgtgccttgcttggtaaatggcaaataaagatctctggtgcacatttaaaagaatgctctttttttttgggctctctgaaggttgacctgctctttctttctgaactgcaagtgctacatgatatttcaagcttggtaagtaggctgctctaattttttaattccatttattttggtttctagagaatccttgaataatagtaaaggcagttgaaaagtttgattaagtatgccctagatttatgatcccatgaaaattgaaaaattagtggcaatattgggaattttgaacacatccatgttatagtcaaattattttgcatttctgctttttagggagagacaacatatcttccaagaacacaagcctgggcgtaagaacaccctggccatagtcctaacttggctgttgatttcttgtgagacttaattcctatctatatctttgggcctaaaatagaaataatagtttggactaataatgctgtcagtcaagtcaagaagggacgaaatccgtctgaagggtatttttttggtgaatgattttttaaaaatcatccttgttactgaaatagaaattcttatctgtttgctaccttctgaagttgttttccaaactttttcaacaggtgttggttcggggagtctggaagtgtagtgcattcctgggatcaaactggtccagccatctgttctttcatacgttggcccatacctgagtttttaaaactgaggaattttgttgaaagcttttattaaatatccaaggagtcttgtactgctcctaaacatgagattcgtgttggatttatcagaaacgcttattcaaaccagtttcttttgccaccattttagactatttgcatgttgtggtacactggtatggtttagtttagcctagtttagttaggcataaaactttaactggctgtgtttgacgtctttcatcttactttatccgctacctttttttgtttgtttgttctcctaagctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaaggtaaatatcaatgcgacatgagaggttggagtatgaccatttcacttttagcctcttaatagaaaaatctgctgtttcaaacactgttgattgaactcttatttgccttctttggggctcctctaattatactggccaaggatggagtagggtcaaaaatgtatattgatatatttcttcctaatgctagaaagaacagcattaggaaaagttatctcacacaaagctttacaaaattattgtggtaaaatatatataacataaaattaccactttaaccatttttaattgtacagttcagtggtattaagtgcaagtacgttcacatgttgtacaaccatcaccatcttctatttctagaactttttcttcttccccaactgaaactctgtactccttaaacactatgagataactgaagtagaacacccagcacagtaccagacagtaga

SEQ ID NO: 136899 - DNA, 1065 bp, Homo sapiens
gtttgtgattaaccagagaccacttaggaagatttcatttctctttccaacttcccttcctccaatttatatgctgacaaattcagtctcttcttaaagtaattttagtctaaacatttgaatatatgttaaagcttaacacttttctgtatagttgagcaaaatcaaaacctttaagacttgcttattgtaagatgtagtatatttcatgagccaggaggtaagtgtacattgttcttgtagctgcacaaaagctttaaaaataattttaataagtatgtatttgactcactgcataaaatgataagtaggaggtaatgcatatgttaattagccaatgtggacttaagccattccacaatgtgtacatatttcaaaacaatatgttgatgtgataaatatatatgattttaatttgttaattaaaaatgaaaaaagtacatagttgagattcccaataatgttaataactaactttcagtttgcagatgacatgtacagtctttatggtgggaatgcagtggtagagttagtcactgtcaagtcatttgacacctccctcattaggaagacaaggactatccttgaggcaaaacaagcggtgagtatattttgagatcctgctttaaaactgtaaaattaacttcttataaaaaaaaaaaaaccaagtcctatatcacctaagggtgacatgaatgagcagtcagtaaatctgaaaaacaatttcagttaaaacgtaagcttcttgttcacatacatatgtgtgctttgccagtgatgatcagttctttagggttataatcagataatgcaagaatttgaattagggataaaagtaaatctgtccaagattataattcaaatatcagtacacacaaggagatatcagaagttaatgtggcgccaggtgcagtggcgtgcatctgtaattgcagcttctcaggaggccaaggcaggaggattgctttagctcaggaggagtttgaggccagtctgaggaaacatagcaagaccctgttttgaaaacaaaaagaagtgaatgtgtgcgggagtggtgtggtgccc

SEQ ID NO: 136900 - DNA, 1053 bp, Homo sapiens
tgggggatgggaatggacaactccagataaagctggggaccccgagagagctgtgccctcagtgagagggtagactggaaatttttgcccaccagcacagggaaacagaaaggcacctgggctctgggtggtcagcacatgtgttgagagtggggatgcctcccagagaattcttttttttttttttttttttttttttttggattttttggagataggatcttactctgtcacccagactggagtgcagtggcacaatctcaactcactgcagcctccacctcccagattcaagtgattctcctgcctcagcctcctgagtagctggaatcacaggcatgcaccaccacacccggctaatttttgtacttttagtagagatggggttttaccatgttggccaggctggtcttgaactcctggcctcaagtgatttgctcacctcagcctcccaaagtgctgggattacaggtgtaagctaccatgcccggcctatgagatttctttttagggtgatagaaatgttctagaattagattgtggtgataactatgaaaccactaaaattccttgacttgtacacttaaaatgggtaggaaaaagaacatgtttatcaaaaaaaaaaaaaggaaagaaacaaagaggtcttcatgggcgtgaaatcctttaacgtttgcctcagctctgagctccccgcaggtaaatatgcatgcctgtgtacccattctctcctacatttgaaatcactctcttccattagtttaaggagacaggagtttaaggaacatttactgagtactcacaacattccaggtgctggggctgtagggacaaatagatctcggttacattttcgttctcatcctcactgccaggcaccctgcccccatttctcccacctcatttgactgccgcctcctaacttgtctgaactcatctgtctctctgcttcccagctggctcctcccaaatccatcctacacattgtcatcaaagttatcttttttcttttctttttttgagacagggtctcgccctgtcccaggccggagt

SEQ ID NO: 136901 - DNA, 3096 bp, Homo sapiens
ttcaccatgttggccaggctgctctggaactcctgacctcaggtgatctgcccgccttggcctcccgaagtgctgagattacaggcatgagccactgtgcccagccttgctgctgatattcttatacatgtctcttggtacacatatagaaattttccctagcgtatggacttactggatcacaggatatgcacaccttcaactttattaggtattgtccagttttcccaagcatttggactggtttatacttccaccatcagtgcaagtgtcgtctccacaaaggcgctccttcttgcttcctcctagtataagtagctgttatgccacttatgaagaaatgtttgttagacaaatgaatcacagtcactagactgggataatttcctattttaaaattcttccctcttgatttttctttcttttctatattgtagaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaatttgtgtcattgcagtactaaatctattttatattgtaaaaacctaacaaaacaggcttttctttcatcaggattggctgttttgttgtacagataatttcatggtgtttcttttacacttgtttattctcgctgcctcctgagatttagtactaatgtaaggaaggcattttaattaccattcttgttactgaatttatataggatatatgagaaatgcatactttatgtaggaaagggttacatttttctatagcttttttttttttaaattaaaaacattttagagaccagtcttgctaggttgccaggctgaactcctggcctccagtgatcctcctacctcagcctccccagtagctgggattacaggtgtgcaccactgcacccggccctgtagcatttttaaagatgaataagcaactaattggttagaatatgaaggactgtctcaggtaaaggtttaaggtaacaatttgttttctttttcaaaaaacaggatctttaacttcattattatatagcaagattattttagtatgagcattgtagccctgaccctgggatccttccttgtatttagtattagctgtttctgcatcttctttgcaaagatcatcaaattatttatacatagcattgagtttggcaggtttgagaaggtagggtttatttagttgtcaattactgcaagatgcccttgacaattacagtttcaaacccccatagagtgaaggaaatgttggttttctttttgcctctcattgaagtataaataatagggaaactgatactcagcttcacagggaagaaaaactacattgttctaaaatcactcttccatccctacttcctgccagagtgatgggggtgagggttttcagctgtttatcaccaaaacagttcccactctgaccccatggaacgcaacactgcctaagtgtagggagcaggaacctatcatgcgtcagggtggttagaatccatttgtctttcacaactttcttatataaacattgccggagaagttagattgttatgattaaatatgaaataaaccaatgcctttttaatttaaaactgatgagactttaagttctaggggaagaaaaaaaaattaattacatgacagcactaatccatatagggtaaatggcatcagcatccttctatctatgttaggcagagagcaattcattaaaataaatgttctgccaagattattatacctgttgctgatgatttgctcttaaattaagtctaatttgctcaggaacataaatcacagtgtcgatttgtgtgagaggcagaaaaggcagactcatggcagacgattccactgacaaagagaaaacccaatcactttacatctcattggtggactattctaggtttataaaatatctgagattctgcatatgtagatattgcttatggcctaattctattaggaataatatagaattgatttttattttctttggttatgtgtttttttgaaggaataatctgaatccattttcattgataccaagtaatatggaaactgtaaacttactttttttttttttttgagactgta

SEQ ID NO: 136902 - DNA, 2262 bp, Homo sapiens
ttcgcctttccccgcatctacttgtttccaaggccagtggtacttaactgggtcaagttgcctgtggaccttcaggaacagaattgccatgttcctcactgcctgcaggaaaggctccattccaagcccagtgaagatgtgtgcctatccagccgcccaccaaggatgtcatctgtagaatgggtggagggcaggggtttatttggtgtatatttttacattaaaatgcacttaatatcactttgtaaagcccagatgagtgcaaatgtgcctgtaacttcctcctttaatctgtccaggtagtatttagtctttagtcttacattttctttctccctttatttcatgaaattccttgagaaaacttcaacagtaaagaaagaaatttcattcatctcacaactcttccaaacgaggaaacttagtgaaatatttcagagcttctagatgtgaggtacaaaacttgggatcaaatggaatcttgattcactaaccaatttaagatctgacttctaattttaggaactttgggttatgaacgcttccattttatacctgtgtctagttagtttctgcctatctatccaagaagcttttatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggtgtgcacaacaggatgtgtacagcagcactgttaaagtgtagcacatccatactacaggatcttatgcaactgttggaaagaatgaagcgatgctgcactgtggtcatgcagtgatctctaagacatattaactagaaagcaaaaggtttaacaatgtatagcagctgggcgcagtgactcgcgcctgtaatcccagcactttgggaggctgagtagggcggatcacctgaggtcaggagtttgagaccaacctggccaatgtggcgaaacgctgtctctactaaaactacaaaaattagctgggcgtggtggcgcgtgcctgtaatcccagctactcggcaggctgaggcaggagaatcgcttgaactggggaggtggaggttgcagtgagccgagatcacaccactgcattccagcctgggtgacagagggagactccgtctctaaaaaacaaccccccccccccaaaaaaaaaaatgcatagcaagctgtaatgctctttgtgttttagaatagtagaggtctggaaagttgtttgcttttccccagtttttttttgctgtgttacctctgaagggaattgaggtagaggggagagttagaaggaatattcggcttttctattttatatcctcctaggtgaaatttttacaacaaacatgtactggtgtattttgaaatgtttttaaatttttgtatttcaaaataataaaatataaattcaaactgcaagctggctgtgtcgcatttcctggactatgttgtagcctccattcctccattttgtagctccacctccagggtcacctgcaaattgtcagggtcgtgggaagaagcccagcaagtggatcactttctacatagggctgtctgtttcatcgtgaagaggcttgtcttcgtccagcaatatgatttgttctcagcctctccctgggacacaatatgtggctcatagttttgaaagaattagaggaaaaaaatggtattagcattatagttgcaaagataaagcagttctttggatttagcctattcttcaccagggagctcagagtacctaaggaggaagacattacatattcaactcagagtaaaacacctgattctgggaaatgactaaagtgtgttggtgacaaaaactggaaaactagctctgccaattcagaaaatgttactggttttataaagttgtggagatctgtagacagtttaaattgccaaggttaggattacgtttgagagtttgggaagattatgaaatgattgttaccctaatgatttaaaaagttcatttttattaaagtatgaattacttacttggctttaaacactaatatcctagacaacaaagggtctaagtgaacccagctaacttagttgggtgggcatattatgaattagatgctgtaagtggagcattgcattat

SEQ ID NO: 136903 - DNA, 1086 bp, Homo sapiens
acattgcatggtttcctcttgcagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggtgagttcaggcagatgatggtgttaaagaaggacagaatcacctcatctctttcatgtctattctctcatgtgaggccatcatgaacacacaacaatctaatctgaagtttgcctttgtccttattgtttcaaagaaaggacactgaggtttgtgttcttcacttaatgattcttacgtctgtgaagtaattcagcatcaactccctgtttagccaaatacacctgaagtcattggtctagaattaaatgaatcagctttataacataatcaaaaagcatttctgccttaaaatgacaccattgatgcctagctcttaccatggcattaatagcaattgactagtcaatttccataaggagaacttcttaaaatgagtaactgtcttcagcattttactttttcccccctcaaataaaaaaaataaataaaacattctctttcattttaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctatgccaaaacttgctaccaggccaggtgtgatggctcacacctgtaatccccagcactttgggaggccaaggcgggcggatcacctgaggtcaggagttcgagaccagcctggccaacatggcgaaaccccatctctacttaaaaaaaaatacaaatattagccgggcgtggtggcatgtgcctgtaatcccagctactcgggaggctgaggcaggagaatcgctt

SEQ ID NO: 136904 - DNA, 1012 bp, Homo sapiens
agaagatctgggaacacagggctcatgtaactcccatggcaacaagccacgtgttaagtagaggctgccccttgagatagggcctctgctccccagtttgccctgaaccagtcttttagtagggagatgactccttaccattacacatggccagcttccctcaggctacctgcctgacctttgaaggcaaaaggagaccttcacttcttggtgtctgccctctagacaggatgaaactaaatgtggatccaacttgcggggctggagggctgaagtgtcctccactctgatacaggtacatgccagattatgcccatgatcccaagaaagttccagtccttctcatctgaagactgctcttgttgattttataattaacaaagcctctctatgattttttctttggagtgaaagatctcagtttaccccattgtttgattttgaagccttttatctttttgtctttctgcaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacaggtaaaaatcatgtttaatagttctggcatacagaatgaagagagagaaaacaacaacagccacacatttagaatttgaagtttattagatttaacctaagtgttagaatgtaagcaggggaaagaatgccaatatgaaatctgtaattatgctgggctgagaagcttttctgtggtcacagtgcactattaatatggatccagttcattgtgtttaattataaattatttgagtaattcagtggaatgccttcttcatgaaatcagttcatatatttgtgtggcaatccctcagctgttgacgtctgactgggctgttcacatccccgaggaagatcagcgagatgggtgtgaatgtgaaatgggaacttacctgagtgagagccaagtc

SEQ ID NO: 136905 - DNA, 1031 bp, Homo sapiens
tttttttgagacagagtctcactctgttgcccaggctagagagtagtggagcaatcttggctcactgcaacctccgcctcctgggttcaagtgattctcctgccttagcttcccaagtagctgggattacaggcgcgtgccaccacgcctggctggtttttgtatttttagtagagatggggtttcaccatgttggccaggctggtcttgaactcctgacctcaggtgatctgcccgccttggcctcccaaagtgctgggattataggtgtgcgcccggcccaaaatagacttctttcagagggtcggcctgtctgtggctattaaggcacagaaagatagtgatgatactggctattgtacctgttgacgggccagccagggtttacaaaattctgaattatgtggggctcaggtgtatgatttcaccaccatcaggagcatagccctgactctcctgggcatacatgagcacttaccccagccttttcagaatgctttcatgagcagccctgtaggaggcattgtagttgcttgcctattgatatgtgttttcaatggaacaggtctcttaaataaaagaggttttttttgttgttttttgttttcgtttttgttttgaaacagggtcttgatctgttatccagactggagtgcagtggtgaatcagagcttattgcaaccttgaactcctgggctcaagcaatcctcctgcctcagcctcttgagtacctgggactatagcacacaccacaatgcatggctaatttttttttttaatagagatgggagtcttgctttgttgcccaggctgggctcaaacgatcctcctgcttttgcctcccgaagtgctgggattacaggaatgagccactgtacccagcctatttagagttcttattgcgagtaactttttgttctagtcccttggcaggagtgtacccttgtgattcttagcctagtaaagttgttgcatcccagtataagttgagaaatatttcaggaaagaaatacgcccaagctttcccataa

SEQ ID NO: 136906 - DNA, 1002 bp, Homo sapiens
actgctaagaaggggcagtttgagtctgagctagtgctcctaaacactggacatttttgctgtgaaccacagtcgggaaggtttaatgtttagactctttcctcagaggcttttaactacacacaattttgacatgttttccaagctcagaaagctcattaaaaacaactaaaactgacctgacttgtcacttggagttgacaatcccagtgccttctgacctttgtggcacttctttggaacttaaatcagacttccatgtgcaaggagcactaattatcatataatcaagaatactagataattatcgtctaacctttgctaggtgcttcaggatgcccttatctggctcaggtgtgcagccttctagaatccaagtgatgtgttgccctaaacaggcaaacgcccccttctgggtggtccagtggcgggggattttgagttttgggttagcttggcacaccgcaggcagccagcggtcacgtttcactaatacctcaatttgctacagctggtctgtgggcttaggaaccagtaactctagaattgtataatgcaaagaacatacacgattcaagcaatgtgccctgagcaccttgtacatctggacaataaaaaaaagttaaaacagaagtgccctacattaggagagggagtcgaatcggatgctgacagggtctctgtttgggggacgaagagggcctaagggtttcaaatagttaactgcttccccaagcaccaaagttgttagacgtcagacgtcagacgtcacccaagtggggtggagccgacgtgccccggaagtcaagatgccccgccccgggatcggtggcaccgcgccgcgcaggcgcaggcgtcgctgccgccggcgcaggcgccgctgcctcgggtacttcccaggctccgcgcctgcgcactgccgtccgccacgccccgcaacctcctggttccaagtgggagacatggtgctgtcggagctagcggcgcgcctcaactgcgccg

SEQ ID NO: 136907 - DNA, 1048 bp, Homo sapiens
ctcagggcacattgcttgaatcgtgtatgttctttgcattatacaattctagagttactggttcctaagcccacagaccagctgtagcaaattgaggtattagtgaaacgtgaccgctggctgcctgcggtgtgccaagctaacccaaaactcaaaatcccccgccactggaccacccagaagggggcgtttgcctgtttagggcaacacatcacttggattctagaaggctgcacacctgagccagataagggcatcctgaagcacctagcaaaggttagacgataattatctagtattcttgattatatgataattagtgctccttgcacatggaagtctgatttaagttccaaagaagtgccacaaaggtcagaaggcactgggattgtcaactccaagtgacaagtcaggtcagttttagttgtttttaatgagctttctgagcttggaaaacatgtcaaaattgtgtgtagttaaaagcctctgaggaaagagtctaaacattaaaccttcccgactgtggttcacagcaaaaatgtccagtgtttaggagcactagctcagactcaaactgccccttcttagcagtttgatcttaagcaaccttaatttgatctcaggcaaattacatttctctgggcctccatttactcatttttaagaagaggatatcaataacctaccacattgggttgttgtgaggattaaatacacattgaaatattaagaaaatgcctagcacacagtaagctctcagtaaatacttgctattattttatattgacctaaatatgccctttcatcaatcagttatattcttgggcaaggtattttaacaaatcactggccacttggaagtggaggcaacttgcagaaaattgtgagcataccatggagttcctggagttgtgcagcacagtgctggctggcctctgctaactttgtcttaataacctcaatgctaaatccatcctaagtaaatttaaatcacatccttagacacactgtccattctcaaaccgaatgaaaaaaaaattccacaaga

SEQ ID NO: 136908 - DNA, 4431 bp, Homo sapiens
tcacttaacacgtaactcctggcagtgctaaatttggggttgcaaaatacaaagctcagcaaagagaacttttcttccattttgctcatttctaatattaaggaaatttaaaatttgcttatttctaatattaaggaagttctctgtatctctctctgtttagaatagttaaataacaattatgtttttaaatgagggaaagttgttctctgaaacatttttaggtactacagtgtccaaagttttctagaactaggaatcaggagagaaatgatatatttagctatttgtttccccacattggatatgcaggcgagttctcactttaatgtataaggaatacactgggcagtagagaagggtgtgcttcttttgttgtaatacttcttctacttcttacaattttctgctttcatcctttgacttctctcttctttcagctaaaaataggtcctcaagaatcaaagtttaaagctatcagaattctcaaagtaacagtccagtagaaccttgataataaacaccattccttcacaagcagatggctgtcattatcttatgtgtttttatgtattatgtcttgtggaatttaaaattaaaaggaaaatgttttgatcctattgggatcaagcaagttttcttgcctatcaataatgaaaatgtgttttttaaaaaacaatacttctccttttcagaaattgttgagatattttggaagtgttttcatttttttccccccttggactgggcagacctttggatttcctttttctttctgtaccttctcatgtgcacaggatcactgcacatcctgccctttgctgaaaggccatggttcacatgaggtcttcagttctcccactttcagccactgtatacagtgttagaccatgctgtagaggaagggatccagcttttggtttataatatttaaatacttgtaataattacaagaagcagagtatttggtttctttgagcaaaggagaagttgacaggatgaatcgccagcaccctccccacccacaaatcctgtttttggattgttggtgtaccatacttcagtctcccaccccacctcccacacccatcacttctcttctgatgaagtgcttttaagaaaatcatttttgtatttaattgattttaatgttgaactctggaagttgaccatttccttgaattttgggagaaaactccaatagatgtcagagacatgcactgtccagtataactgccactagccagcatgtggctatttaaatttaagttaatgaaaattaaataaaactttaaattcagttcctcagtcacactagctatattacaagtgcttaatagccatggcacacttatacaacatttccatcatcacaaaaagttctattggacagcgctgtcctaaacatttttatctggcctttaatgcaacgtttgaaagataccaccaaagttgtaactaatgcataaatataaactagatgtttttatgatatccaaaatgcccttataagcactcagtagccttaaagcccaacttcaaaggcttatctaatgctacagtgtttctaaacagaaactctagacatatcttcctaaatacaaacctaactgggacttgcttgaagtttcctcctgagaaaaaaaatccaaaccaaatataatctgatacttaacaccacagcttaatccccaataatctgggcagttaaaattgtcttttattttgatctttaaagttctcactaattttagatttaattaccccttcccttaccggtgtgttaacatctttcctgtgttgtgaatagctaatgaccatttttctctgttgcaggtgaatgcacaatatttgcagctgttcgtgatttaatggctaatcttacactgccccctggtgggcgtccatagacactattgtttttaaaccaggaaggctgacagatgagacaacaaaaaaaatctgaattcagccttcagtttaaaaaaggaaaaggactttttttttaaactttaagagctaaatattctaaactggcaaaaattttcagggtgcacttctttcatcaaaatgatcatccatcttttgtataatgaacttgtatagtgtgtttaaatgggacacatttcaaaggaaataaatcagtgtccgtttgccagtaataaatttaatattctgttttatactataaagttatgaaaatgccaaacttgtttatttaattgttttcttatgttttgggtgtaatagtccttttttggtttttgttttgttttttaaggcaggtctgtcatttttgaatactgtaaaactgtgataaactttatattgaagctgtattttaatatgaccgctttgaatccttacatgaaatgttctgggagttgttataaacacaccccaaggaagcaatatttaataaaactaggtcaaaaacaaaacaaaacagtgacactcacttgtgtgtatataaactctagagacatcttaggccctcccttcatctttaacctggtggatggagccagttattaatttataataatacatgtctgaaatttgaccaaaaacatcttctttatgtcaaggttaatatattttcttcagacattcctaacttgactagtggttaacatttagcaccttggttgtctttcaatatataggatttgggtgaaaaataaggaacttagtctttgagaagggacagtatgtggttcgtattgatcaaggatcccaaataatgcaatcattctcatctgttgaggatgtgggaacttttctgtcaggaaaatttagtttacagaatacttctgcatacaacattaattaggaaacaaagaactttaatgctgtacctctgcatgaagtttctgtgagctttctttatcttgcttaacttatcctcctttccttccccaccaaaattgggattgttctaaacaatttcaatttaattcattgtcaacaaaacgatagaatgttttgcttggaagaaacctggtccattcccctcattgtgaagaatcccgaatcctgggcctgtccagggtcaaatggagtttttggtattaatacatctctgcagggtttctttttggagcactgtgctgtctttcctagtcagtcagggacttttttaagcttcaaagaacatggtctgatgcaaaggtcttctaccgacttcatggtatttaggaaaaatttttaagtgataataccatgccgagttacctggtcactgtaatactggttctccattaaaatgtagatgctttgtctaattccacttcaagatgatttaattgagcttctataactatcaactatcaaattctagtttcaagtatctcactgtacctatatcatatctgttctcaactttgtttgattctccactcattttcaatcagagttgaagccttctttgcctttcttctttgtcttatttctgccttcatctcccacttctcacccaactctgccactgttcaggagcagttgactaaacttttatccttcctttaacttaatctttttatccttctgtttttagttcttacagtggtaatcacatcagtttggcaatctaagatgtctttatcaagggtcagcccttttctatttggagctgaatcttttctttcatgtagaaatctacatgtatatacaagaaatgtatttttatctgcaggataatattgtttcaaataattttattaagagttaactttttaggtattttcccttttaatgtggttttgaaatgttaattgcatttttacacatgatgcattcagtggacactcttttttcctaattataactcatctctgaatgcattgtgccaatcaagagtaagataggattcagtgcgcaaaatttgcttttgatgcttattaagagtaaacccatgaatttgaatttttatattatgcttggtacttggaattgatatataccttattaaagcttgaaaacatttagcatttgaatagtaagtttcatcacaaatcatgtcttttgcctcttttgttacccaggttcgatcaaggggactggatgcccaagtgattttctctaataatcgggttgggacttaactttaaggtgttttcaatgtgattttagtatttacagtaataaataaaatttatacaaagtttcagagaactaccaactctctagttaattttgatgaagatgttttcattaatagtctggtttagtattaatttaaccttgaaataagaaattggtcctgatttgccaccttcatttttccatctgctgaaatgccatttcagaatgtataaaagtactttcagaattagaagaaaagtgagagcttcagcagaacgtgtcaagtcgctaataacaggagtcgaaccttatgtttgaaaattaactgagtgagttaagtgcaagcat

SEQ ID NO: 136909 - DNA, 1027 bp, Homo sapiens
tttactcttaataagcatcaaaagcaaattttgcgcactgaatcctatcttactcttgattggcacaatgcattcagagatgagttataattaggaaaaaagagtgtccactgaatgcatcatgtgtaaaaatgcaattaacatttcaaaaccacattaaaagggaaaatacctaaaaagttaactcttaataaaattatttgaaacaatattatcctgcagataaaaatacatttcttgtatatacatgtagatttctacatgaaagaaaagattcagctccaaatagaaaagggctgacccttgataaagacatcttagattgccaaactgatgtgattaccactgtaagaactaaaaacagaaggataaaaagattaagttaaaggaaggataaaagtttagtcaactgctcctgaacagtggcagagttgggtgagaagtgggagatgaaggcagaaataagacaaagaagaaaggcaaagaaggcttcaactctgattgaaaatgagtggagaatcaaacaaagttgagaacagatatgatataggtacagtgagatacttgaaactagaatttgatagttgatagttatagaagctcaattaaatcatcttgaagtggaattagacaaagcatctacattttaatggagaaccagtattacagtgaccaggtaactcggcatggtattatcacttaaaaatttttcctaaataccatgaagtcggtagaagacctttgcatcagaccatgttctttgaagcttaaaaaagtccctgactgactaggaaagacagcacagtgctccaaaaagaaaccctgcagagatgtattaataccaaaaactccatttgaccctggacaggcccaggattcgggattcttcacaatgaggggaatggaccaggtttcttccaagcaaaacattctatcgttttgttgacaatgaattaaattgaaattgtttagaacaatcccaattttggtggggaaggaaaggaggataagttaagcaagataaaga

SEQ ID NO: 136910 - DNA, 1117 bp, Homo sapiens
gcgccgccgattgcacctcctgggacgcctgctgtggtgctgaaatccaaaatgctattttttgtaagtaccacccagcatgtgtgcatgtacagagcttctgagggaaatgccacatgataatagagcaacttttggataactgcataaattatctcttgttgccaaatagaggccaggattccttaattgtcagcgtagatgtcatgacatcctggttcctttagtaataaaacagaaatttattgaaccaggtaattgtgtagcacagttgcatcttaaccataatattcagttgtttgtcacttttcttgtcatgtgtaattttcttttgcttgcttatcttaatctgaaagtacagtaaatgatagtacctttgatacatttagacagatgttttatgatgtttttattctctttgtgtgtgttgtgtgtatacagcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtacatgaccagtagacaatattttattgcatatatgttataaaagttcttttgagagacacccctttctcctcttctcttctccctccttacctactctaccacccaatcatagcaatagaggtctggttgccgtggccctcttaatgtctgcctgtcgctttcttcctttctcactggttcttcatttttgtccatttctctgctgcctggactttttgttagtgatttactattgggactgacccagttgctaatgccagaagcttgtatttatagcacacattgccacaaagacctaggttaggatgatagaattttccacggctgtgaattcctgccctaccatcaatacctgccactctgtacatcacaaagttgaaatgcatgttggtttctcatatttcatggttcaatcacgaatagaagaatattattaaaagttctgtatcttctaaatgttttgtgaagaataaaagctga

SEQ ID NO: 136911 - DNA, 1054 bp, Homo sapiens
caggttcttggggagggaccgatgttttctgagttagttgaagctgtatacacacaacacacacaaagagaataaaaacatcataaaacatctgtctaaatgtatcaaaggtactatcatttactgtactttcagattaagataagcaagcaaaagaaaattacacatgacaagaaaagtgacaaacaactgaatattatggttaagatgcaactgtgctacacaattacctggttcaataaatttctgttttattactaaaggaaccaggatgtcatgacatctacgctgacaattaaggaatcctggcctctatttggcaacaagagataatttatgcagttatccaaaagttgctctattatcatgtggcatttccctcagaagctctgtacatgcacacatgctgggtggtacttacaaaaaatagcattttggatttcagcaccacagcaggcgtcccaggaggtgcaatcggcggcgcgctgggagggatcgtcaggcaaaactgaacattccattttagctgtgttgcttggtcagggaactattttgagggggaaaaatcaagataaaggcatataaacatttaaaatcatattctaggtaggaaagtctgagaggttagaattttgtttcatacccaattattaacagaacataaagttaataactgcactttttcaaaacaaatacatacatgaagttgctaactgaaaagtcaactgtggacttatgtaagattttccccttccttccctcccacttcgttaattcctaaggcctatggattcggcttctgcagggtctctgacatctgttccctcctctctatattcattgaggccaccatgtgcagggctttattacttctcctgtgctcccctaacagctctttccagtggctgcctcttccagtccatcctcataccaccatcagatataggtcctacaacatggttccagtcaagctcacaaatgttcagtgacatttagtgacacatgctatccccctaccacccacaactgaggaccaacacctagcattcaaggc

SEQ ID NO: 136912 - DNA, 1028 bp, Homo sapiens
gtcagtcctctggatcaaactactgcatgaattcaggctcaagtttttttatgttgttttgcaagaatacttcataggtagagttatgttcttccatcaagaggcacataatgtctgatcgcatctctttttgcagtgttgccagcagctgatgctcaatgctgtaggtgcctttgttttggaataggtatcaacttagtggttttccttttggaacaattctcagtaacatcttcattttctctttgacttacatgttaatttgatgtgtccttgttttgtagctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagtatgtgtttaatagtgcataatttgaatataattaatgaaacagaagcattaatgtagaatgaagagtaacttgctttatttatccctgtaggttgcaggaccaccatttaaagctaatacgttaatagccttcaccaagctattaggagctcctacacacatcctcagggattgtgtgcacattatgaagctggagctggtaagtcacagagatatacatttctagcaaggtttgtttgaggaggttagagttggtgggagcagtgtttattggttttcacccatctatgtagtttcttctatttttctcttaaattcttaatttttaacttaaattttatttatctttgaataggtaacacaattctgttttatcttttgaatttaaaacaagataatatagtgagaaatttcccatcagttcctgtctagctatccctgtcccctctatccctgtccaactgtcttctggccaaccagagttaccatggcttgcctctccttccagagatggtccattcataaaagcaaataacattgctctcataaacttttgattgat

SEQ ID NO: 136913 - DNA, 1064 bp, Homo sapiens
gttgaaggtatctggaggatgaaatttatttattttttatttttgaatatcttcgtagataccaatggagggtgaaatttaaatatcaaattgttcaggaagtcactgctttcaaaacttgagtcttggttcatttcttagtcaacgtagtctaaataaagaatatggaaaatttccttctcctcattctacttagagtagaatgaaaatatggtttgtcaaagttggtttaaaaatataatatttctgcctttaaaggaactctgagattgtttgcttaatattttaatgcatatagtagcatacattgttacatattacatacattgaagcttgtgtgaaggtaaattttatcctctctcaagctttatatttttctaatttttgtatcatgttaaaaagtaccttacacaaaatagagattcaggcatgacatgttaacacacatcaagcttcagtgaaacatcttattggaagaaaaaataaaattattactgtgtaaagatttgaatgctgtcaaataattttcagttattaaaatataggttttgagaatcatttgtttaccttttttataggaactcttgaccctagttccccatacactatggtgtcaccaagtggacgagcagggaactggccaggatctcctcaagtgtctggcccctcaccagcagcacgcatgcctggaatgtcaccagccaacccctcactacattctccggttccagatgcttctcattcccctcgagctggaacaagtaagtatcatcaacatttttatgttcttttttagtataacccaaagtgacctatcttgttgcatcctcacatttgaaagtcatgacctactttttgagagaggatacttaaaggatattacaaaggatgcagatgaagagatgcataaggggagtgcagtttccatgccctctgtgagccttcacatgtttgcctatctggaagttctccaaactctgtccttttgggtttttatggaagtttcatcacgtaggcattattgattaaatcactggccactggtgatcaactttgggggtggg

SEQ ID NO: 136914 - DNA, 1368 bp, Homo sapiens
tcacatagtacagtcccccctcttattgctctccaaggttttagttggcctgaggtcaactgaggaccaaaaatgggcaagtatagtacaataagatatttagagacagagagataccatattcacataacttttattacaatctactgctaagagtgttctattttactgttaatgttaattttttactgtgcttaatttgtgaattaaactttatcatatatgtgtataggaaaaaaacaggtttcaatactatctgaggtttcaggcatccactgggggtcttggaacctatcccctgtggataaggcggggactgctatagtagagaatttgaaacatgctgatattaaaggtaattatgataatgtagcaagtgcttaaatgttgcatttattcatagttttggtagccatagttcacactttcataatcctaaattaaaactagtcctgtgcctttaaataagttaacgtttcactgttttttatatctccaatctcagtctctccataagtctagtattgtattttcttttttctttgattttttttttttttttttttttggagacagagtcttgctctgtcgtacaggctggagtgccatggcgtgatctcagcttgctgcaacctccgccttctgggttcaagtgattctcctgcctcagcctcctgagtagctgggattacaggcacatgccactgtgcctggctaatgtttgtatttttagtagagacggggttttgccatgttggccaggctagtctcaaactcctgacctcaggtgaaccgcccacttcgccctcccaaagtgctgggattacaggcgtgagccaccacacccagccttagtattgtattttctagctgtctattcggcatcatttccatgtaatgtctggtagatatctgcaactcagcatggccaaaactaaactctggatctcttcactgccccagtgctcctcttcccacagacaccccagctcagtaaatggcaggcccttccttcctgctacttgggccgaagctcttcgagtcatgctggacgtctctttcatacccatgttcggtcatttaccaaatactatcagcttgattttcagaatttacccagaatccaaccacttttcactaccatagtctgtcacctttaccaagccactagtcctctctcacctgaattattgcagttgtttctaactggttttcctgtccctacccctacccttgctctatagtctgtcccacagcagctagaatgatccttctgggacagaagttcgtccatgatttccgctccaaactctgcattggattcccactcattcagggtaaaccctaagttcttagagtggcccacaa

SEQ ID NO: 136915 - DNA, 1019 bp, Homo sapiens
ctacaatgagataacactccacacccacaaaaatggttttaagaaaaaaattgataattatttccaacatttgatattaggaacaactgaaactctcgtttgccactagaaaatatgtaaaatgttacaactaccttgtgatagtgataaagatgagtaaaggtcaggctgagctaccatatttcattgatactaaatgccaccaaatgtaagatgcatcagtttttatctaccgctcagaaagaaaaaacactgccagttaaactaacatcccataaatggaaagacacaccctgattttagagatattaaagtgtggggggaaaatgtcttagaatcaatgaaatggtagataaataatagagataaatcggttatatgctagatagaaaatgagcaaaaaacatcttgagggatagaaagcattgcaagatcgggaaagaggatgttgctattttaaaacatttcgaaagtcggggtttataaagacttgtgctggtgatgtgtatttattttgcacacttttatatctcatgtttcctatttggtaaccagcaaagtgtgtaaatattaacactgtagctataattagtgaaagccacactcttatgctccgtgcggttggccattttaccaacatttaattttcttcttttcagccatttccaaagcagccaggaacatcaggtgcttatcctcttacttcaccccctacatcttatcatagcacagtcaatcagtctccctcaatgatgcacacacagtctccaggtaagatattacttattctcttgtcatgttcaactttcaaatccaaaatacacacacacaccccacattgagaagcactgtgcatctagtctcaggcttcagagagaattccctttctagtctatggctagatagttgtcactcatttattatggaaggtttgtgaaatctgtgtccaggcttgggagcactttaaaaggtttaaattaatgtcacccagagccagactcacagcacaactccagggg

SEQ ID NO: 136916 - DNA, 1031 bp, Homo sapiens
atctgggagggtctaagtgtctcttagactttcacttagtccttctgttattagtcccacttttatccccacttccaaaggtacccatattagtctgttttcacattgctgtaaagatactacccaagactgggtaatttataaaggaaagaggtttaattgactcacagttccacgagcttaacagaaagaacggctaggaggcctcaggaaatttacaatcgtggtggaaggtaaaggggaagcaagcacgccttacatggctgcaggggagaagcgtgagagcaggggaaactgctacttataaaaccatcagatctggtgagaactcactatcacaacagcatggggggaactgtccccataatccaatcaatcggtccctctctcaacacggggattacaattcgattacaattcaagatgagattcgggtggggacacagagccaaaccatatcagtgcctgatactgccagttccaaagtatctcagggatctggatggaaatagcttgcttcttggcttttcccacagcttacttaggatacaactttctcacattggatggttctagttgctactcagccatctgctttgcagcctcccggatgtattgctgtttcttctcttctcctattctttttgtctttgttacttattgcttcaaaaaattctttccagtagtttagtggggaaagaatgcaatgtgtgttgtgagcccatcatctttaattaaaagtagactgtagacttcttttttgagacagggtctcactctgtcgcccaggctggagcgcagtggtgggatcacggctcactgcagcctcaacttcccgggctcaagcagtcctcccatcttagcctccctagtagctggatccacaggtgtgcaccaccatgcctggctgatttttctattttttgtagagatgaggttttgccattattgcccaggttggtctcgcaagggatcctcccatcttggcctcccaaagtgctgcgattataggcatgagccaccatgctcag

SEQ ID NO: 136917 - DNA, 1026 bp, Homo sapiens
catttagtgtctcaggcaaaactcttcaaaagatcatggggacttgtctttaatgactaaggctgataattttgtcttttatatcttgaacacttctttgagaattttctttgattcagtgtggacccagtgatctagtttgcattctcttcaaggggaagttttatggaatgtgccagaaggacgttgtttcatttttgacagttatacactgaaaattctgaggttttaacatttgtacagaaactggctgctctcactgtgtttgttccttataggtactgtttgatactcaggctccattaaatgccatcaacaaactccccactgtgccgatgttgggcttgacccagagaaccaatactgcctaccagtgcttctccattctgccacagtcgtccacccacatcagactggccttcaggaacatgtattgcattgatatatactgccggagtcgaggtgttgtggcaatacgggatggtgcctatagtctttttgataacagcaaactagttgaaggtttctatcctgcaccaggactaaaggtaacagactttagtgttataacatgagtaaacataaaaattatctctaaaatagtttctttgagggggaaataatggggaaaagcaacaaattcctgtttaaatttagtaagtagcagtgttaactcatcatctgtataacgtcattctgaaggagctagaagttctgataaagtgttgtgcttatgtgtatgagatgattaaaagtatttttctttatattcttaccttctgatcagtagggtgaagatactaaaaacaatttgtgtttggtctttggaactttaaaagtagtttttatcattgatttttgaaaaggtttggtcatcaattctactgtgatgcttatttatttatgagacagagtctcactctgtcacccaggctggagtgcagcggcacaatcttggctcactgcaacttcagccatgtgggttcaagtgcctctcctgcctcagcctccccagtagctgagatt

SEQ ID NO: 136918 - DNA, 1009 bp, Homo sapiens
caaagaccaaacacaaattgtttttagtatcttcaccctactgatcagaaggtaagaatataaagaaaaatacttttaatcatctcatacacataagcacaacactttatcagaacttctagctccttcagaatgacgttatacagatgatgagttaacactgctacttactaaatttaaacaggaatttgttgcttttccccattatttccccctcaaagaaactattttagagataatttttatgtttactcatgttataacactaaagtctgttacctttagtcctggtgcaggatagaaaccttcaactagtttgctgttatcaaaaagactataggcaccatcccgtattgccacaacacctcgactccggcagtatatatcaatgcaatacatgttcctgaaggccagtctgatgtgggtggacgactgtggcagaatggagaagcactggtaggcagtattggttctctgggtcaagcccaacatcggcacagtggggagtttgttgatggcatttaatggagcctgagtatcaaacagtacctataaggaacaaacacagtgagagcagccagtttctgtacaaatgttaaaacctcagaattttcagtgtataactgtcaaaaatgaaacaacgtccttctggcacattccataaaacttccccttgaagagaatgcaaactagatcactgggtccacactgaatcaaagaaaattctcaaagaagtgttcaagatataaaagacaaaattatcagccttagtcattaaagacaagtccccatgatcttttgaagagttttgcctgagacactaaatgctgttttttgtttgtttgttttttgagacagggtctcattccgacacccaggctggagtacagtggcacaatcaccgctcactgcagccttgacctccccaggctcaggtgatcctcccacttcagcctcccaagtagctgggactacaggcgtgcatcgccacaactgactaatttttgta

SEQ ID NO: 136919 - DNA, 1404 bp, Homo sapiens
taaagtcccatagctagtgagtggcagagttggaattggaaccctctaaccactatgctagactgcttcagtatatctcacctacccttgcccccttttgtagaaacggaagcatattatctgtttgtgctgttgctttttttaaaaaactaaattacttaactagagacctgtctgggcatataatattgccaaaatgccctgttactcaaatttatattttaaaattttacatgtataatattaatctcctttttgtttccttctgtttagacatacctgctcatctaaatattttctcagaagttcgtgtttataattaccgaaaacttatcttgtgttatggaaccaccaagggaagctcagtaagtctgattaaaatgctgaagttcctgtcttatgaatcttaaaaatcaagaattaaaaaaacatgaaaattaccttaatataagtaagagctcaagtaaaagttagggataaaatggtaaattttaaatgctttgtggctataaatatagtatactataatgcttaactctttaaaattgaaaacaaaaataataccctatgatggggtatataatcttgaagcaatttggacaaggtaatgtactgatggtgtttgtatttttttcttcactgattacagatttgcttggcaatgtgattattgtaaggaaaattgtgtatgagtggttataacaatatggtatgtttttgcttttggtcacatgaatgttaacattatttcatcttaacttaatcttgaagtatttcctgtaatctatagttctttattttttttcccacctcatatgtaaagtcctagaaatgtagtataaaaatgcagccagctggtttctctctagacttctacgtcaagtaatgtcaggttacttgagctttttaaaatctgttaaccaagtgtatctgtgtccagagtggcgcccttcccctttatgacagtgctccttagttgatggtaccaaaagtgtgactcttcttcagttcaagagaaaaacgaaaagaaacactaatgataattttcaaataaagtttaataaagttgttttagcgcctttctgttttatttagtaaaagaggactaacacatggtcagggagtgtactgttcaatattaacagcacatctggagttcgaatccagtcttattttattgcttgttttccaaaaaaaaattccatttagatttttggcgttttgccttacttttaacattttttttttctcctacttgaatctgttactttctcagtttctgaaacatgtaatcttttttatttagattagtatccaatggaattcgatccatcaaaaattccacatttctttgggaactgttggcccaaactcaggttgcagtaactgtcacaataccattct

SEQ ID NO: 136920 - DNA, 1078 bp, Homo sapiens
actgtcagtgatctccctggttttgcactgcagggccatagtggggttaatgatgtttgtaaaagccctcacaacaaagctgacacacatctgccagaccttaaaagaccatagcctggctcctcaatttgtttagtactgagaagtacaggagaaaagttggttaggagcagctgtgtaaatcaaacatttttgaattggtaaaaattttcagataggttaatccattgtccagaaaataccttcctcggttcttaatttttaggtactataatagtattttgcagtattttaagtttgtaacaattttgtcaggtttccttttggggaacctggtttcgggttgttgcttttttcccctcacatgatcatgctgggaagataaaagttacagtttatttttattcattctgttccattcataaccttaaaagcaagtaactattttacgaattccttgaggtagagctcattgtatctgcatcacagattaaagtgatatacagtgcactttcagggttccgctgtccctaagagcataaatgggaaaagaggcttacactgatgttagttctcacttgaacacatgctggcttctgtgctttccttttctaactagatagattttgtgaaaaacctgttttatttgaaaggaagataatgtactgcatttatattttcaaacttgagatttaaaaaatctgtctgaattggctgctttataactcctacggagagggctatgtcgtgaggggtaagggcaggcaagtcctcagtatacctgtcacgttgaagaacggataggtagtttatgcaatttctgtaataactacccaaaatacagttgcacaaaatctttctggcagtgataaaaagtatgtagtgtgaaagattaacttttgaaaaacttcaaaagctgtatattgaagaggagctgtgatagaagttttaattagcacatgcaatctattttttgctctcttaagttgtttattccaggtcagtggttctcaaccccagggcagttttgccctgcaggggacttctggcaatgtctgcagatgtttttgatcattaa

SEQ ID NO: 136921 - DNA, 1075 bp, Homo sapiens
aggtatgattccatatgaaaatgagcacagaatttgtgtgtgttaacttggttgtgttctttactcatttttaatatgagaaagaactaagatacagtttttaagagacgaggcagcaataaggcttaagtaacaattgtctacattttcttgaaaatgcttctgttttaattaaataattgtccaccattttccatgagagaacttgtgaaacacaaaatatttactaataaattaccagtgtttaggtcagtatttactcagtaaatacaataacatttgttttggttaaccctgagctttcttccagtattttaactatcttaatgaattgcatcacatgtacttttttttttttttttacctgtttgtgttctttacttaaattctagttgtctgatgatccatgtccagtagaatccaagaaaacaaaacgagcaggagaaatgtgtgccttcaataaagttttagcccacttcgtcgctatgtgtgatacaaatatgccatttgtaggacttcggttggaggtaagttttttggaacagttctggataccccaaatgaaagagtagtttttaaaatgtgttgctgagggtatatatagattccattaggaaaagcagaatgtttgtgatcctgttcattttgggaggagtggtagggttacaatcatagcatctaatggtatacatgtaaaacatgacttgaattatttcatctctctgattccagattctgggtcttctgctctttatggaaattgaatgtaaaattttcccagttaaaaaaagtggacagggctgggcacggtggctcacacctgtaatcccagcactttgggaggccgaggcgggtggatcacttgaggtcaggagtttgagtccagcctggccaacatggtaaaactttgtctctactaaaaatacaaaaattatccgggtgtggtggcacacgcctgtaatcccagctacttgggaggctgaagcaggagaactacttgaacccaggaggtataggttgcagtgagtcaagattgcaccactgcactccagcctgggcaacaaagcaagactct

SEQ ID NO: 136922 - DNA, 1049 bp, Homo sapiens
cttaatttgcaagctgatcttcagccagcagctgttccatatgccagagatcatttgtgtttcataagtaaatatttcagtggagttttttgtttttatgatttttaaggttctaagtctaataatactatgagttttaaatacttataatttaaaaatactgattaagtagactaggagtttggggaattaaaatataggcaaagaatggattcatgtatttgttacttgttctttctgccagtgtacatttgccattagttgtcatatctataatgctccctaaaagttaaagagggaaaacaaattaggttggcttatatctaatggtacatttagtttaatttttctctgactcaaaaacaacatgattttctgccttaaacaataattttcatttgttttatttgttttacactacctagataaagattttgtttctcatataagcaattaattaatgaagtgctttattctgtagaccaggccactctggatgacatggagaagtctgtgaatgatgatatgaaacgaatcataccctggattcagcaacttaagtaagcttatttatatagctcaagactaaaaatggaaacttattttgacaagatatgttttcttctccatcattactcttggtcattcactgtccttaaggtttatgacatgaaacttaagtgccgtttggtaccttagaatctaaattctcttggaatagttccaagatgtcagtttctcatatcaaattctcctctagagcaaatataggtgtgaagggcataacactcagctttcatcccttaccacattttcttctatacaagcactttacaaatcacttacacaatgaattttattgtatcaagtgttctctgtaataaagtcctatttgttcttatccagggtaatcgtcatggttgactaccaactgacactttcaaaatagtcatttctgcttctcgaatacagtcattcaatttgtctcaaaatcctttaaatgcttcacactgttaaactaaataaaattgaaaatggagctagatata

SEQ ID NO: 136923 - DNA, 1065 bp, Homo sapiens
gaaagaggggatctaagataaaccaaagcattagcttatatttttaaagagactaaggagaggggcagcctaacttaacaaaaatgcaaatatgggccttaaaaaagaaataaaggatctgccagaaatttggtgaatgtattggttagatgtgtcttgggggtgcctgtccattagccctatcagggtttaacattagctttatcagtacttcattatcttaatttaattaaaagcttcagtagaaggccctcccctttaatccctcaagcaaagatgttaaatacagacctaaaaattatgattggaaagtataattgaaactctcactggaattagaaaggctactaaccaccactgccttttcgtctttttttcttaacagctttattgagatataattcacatataattacctcattcaatggtttttactgaaagagttgtgcaactatcaccacaatttgattttagaacattttaatcatcccagaaagaaaccgtgtacccattagcagtcacaacccattcactcctctcccttcctgcctcccttttggcaatcattaatctactttctaactctatagatttgcctatttggacatttcatataaatggaatcataatgtgtggtctcttacatactgtttttaacacattttttttgaggttcacagcatgtttcaatacttcattcacttttattgtcaaataatccattgtatggctataccatcttttgtttatccattcatcattgttgaacattggggttgtttttcttttttggctattgtggataatgctgctatgaacattcatgcccaagtttttatgtggacgtaagttttcatttctcttggctgtacacctaggagtgtaatggccgggtcttgtaactgtttaaccttttgacgtgtttaacaccactttacaatctaaccagcaatgtgggaaggtttcattttctccacatcctcaccaatacttgttattgtttgcattcttttacgtgaggatatgcagttatctcagtaacatttgttgaagactattttctcc

SEQ ID NO: 136924 - DNA, 1129 bp, Homo sapiens
aaccttttatgaaacttattttaagtaaatgttacacttcttacatttgtttttttaaaacatctgatactataatatataatttttaagatattctttcatattttataatttagatcagataccattttaattttaaggtctggcattagagcaccataactgatttgtaatatcttctcctattacttaccaaaatgttaactatagtttttaagctatcaattgtaagttaatttttaactcaataccatattagttaatttttaactttaagtttgctttctattagggttaacacttaatcagtgtgattccaaaaggaaatattttgaagcacagtaatctactcttgggcttttaaagtaaaaatgtttaaattgcacatttgaatttgttgttcttatttatgcagatcgaccacttatcaatagaaaaactcctgattgacagtgtccatgcaagagctcatcagaagctccaagaactgaaggccattcttagaggcttcaatgccaatgaaaactgtaggttcttttaaattgacatttgtttttcttttgtttaaactagaatccagttttatttgatgagaatcttaatatgactttttcttgatattttgcttttattgtggaagctggtatttctgcattttaacttgtgatctgccaaacttatgctaatttttcccttgttacttatttagcttggccttatttttgaaatatttgtgtattggatttccttaaaactttatgaaatggggctgggcatggtggctcacacctgtaataccagcactttgggaggccgagatgtaaggatcacttgaggccaggagctttagacaagccagggcaaaaaatgagaccccgtctctatttataaaattttttaaataaaaaagaaaaactttatgaaacatgagctaacattttaatatgaaccttatttttaaacttttttctagtgataaaacagcattccaaatatttataatatacttgtaaaatatgcccctttgagtgaagcagaattcatcccttgtctttttaaaaaatttttaaaaattattaacagttcaaataaggaatgcagatacatggacatagtgaaaaatcttcca

SEQ ID NO: 136925 - DNA, 1043 bp, Homo sapiens
tgtattaattttacttaacaacatctatcagattctttctgtttatcacttcagttagaagtgttacattcccaaactctaatgttaatccgagaacggtggggagaccttgtgcaggtggaaaggtatcatgctggaaagtgcctctccctttcagtttggaagtaagtaaaatcagttctggtgggttcgtgctatgactgtaaatactctttttatttctctttttctctcatacatctgatttaatatacagttgacccttggacaacacaagcttgaattgtgtgggtccacttatatgcagatcaatttgcaagatgtgaaacctgcgtatagggccaaccttccctatacgtgggttctgctggctgaccgcaggactgactgcaggacgtgagtttgcgtggattttggtattgggacgggaatcctggagccagtctcccaagtataccaaggaatgactgtataccaatagctatgcacctctagtaacatgcttttgtgtagtaaggtcccatagtattatgtagaccacataggacatccatagttgacacctgtcttagaacatgttttaaatacatagacatttacctgtttgtactaagacttactattcttaaaaagtttgagaggttagtttactttgggtttataccaaatagctaaaagaccgttaggttagaaaagaccattaggttagattgttgggtatcattttttaaaacatgcatgcttatcacagttttccactttgaattgtgcctgttaaaaactttctttgggagaaaattcctattggactgtttgtaactctcaattccctgtttgaactttacttgattcctgtttttctccccaccccggcatcttattatcccaaatgacccccattttctgtaaaggagtcagaggtgagtagatactacttagaagacaggtagtttttgttttggggttctttttcatgtgtgcatatgttttatttttaaattatatgtcttttttaaatgcaataaatcaaatattgtattgga

SEQ ID NO: 136926 - DNA, 1067 bp, Homo sapiens
accagcctagacaatatagcaagaccctgtctctacaaaaaatttaaaaattagccgggcgtggtggtgtgttcctgtagtcccagctacttgggaggctggggttgggaggtgggaggatcacctgagcccagggaggttgaggctgcaatgagccatgatcatgccactgcactctagcctgggtgacagagcaagatcctgtctctctatatatatattcctgcaaaataataaatgcatgcagcaatttatcctgtaatttgaagcaagttttataattgtaactgcctgttgaccgtggaagtttcagtgtttctcagagtacaatgtcaagtttctgtagataatttcagtgctttttaaaaaaattcattgttattatgtgcttccttagttggtatagtgacacacttgtacacctatttaattaactgctttcttttcttctgccaacggaagatgggcgagctttggttcatagcatgcaaatcagcttcatccatcaactggtgcagtctaggctctttgctgatgagaaacctcttcaggatatgtacaactgcctacgtatccttctgaaatttgagacatatatttgtaaggattttgtggtacctctcccacatttttcatttgtccttagtcttgaactgtagcagcctacattccttgcccccatctcccccaccctttttgaggtgcagatagggctggagaatagtgaagaatagtgatatgtttgtaataaaccaaatttaaaattttactgttgactttgcaggtaaaagcaaaaagtgattagttaaaaatagtcttgtttgaggctgggcacggtggctcatgcttgtaatcccagcactttgggaggctgaggcgggtgtatcacttgaggtcaggaattcaagacctgcctggccaccatggtgaaaccctgtctctactaaaaatccaaaaaaaaaaaaagaagcctggtgtggtggcgggcacctgtaatcccagctactagggagcctgagacaggagaatcgcttgaacccaggaagcagaggttgcagtgagccgag

SEQ ID NO: 136927 - DNA, 1032 bp, Homo sapiens
tgggaactggtgcccttttgtagaatgaatacagtttcaggctttggtaaagatcagtttcaattcctttcacttaccaaaagggttactaattacttactaattaaattactcctaatttcagttatgaacttataattcataactcctcatttaatcccttctgtgaagcagtttacttctaccaccatatactgaatttagtatatttttgtaaacaacttttattacaatataaaattaattttaaaatgtgacttattgctaaaacattctattgggtttattgctctgaggtgaaaaagcatatgcagataatatacaaaatgtgacaatagttcatatttagataaatattttaggtggctcattttgtagtggttgtaagcaaaggctgatttatttatttatttatttttgcttagctgaaataaattgtgaaatactgtttctaatatgttggttcattaagagttgttttattttataggaaaatagaaatagtgcagtttgctagccggacacgccaactcttcgttcgattattagctttagtgaaatgggctaataatgctggcaaagtggaaaaatgtgcggtgagttaaactttttattttactttgtataaaataacttttcgaatgttatgatagacatagttttacattttagctttaacttatccctgctgatttgagtgacatgtgaataatcatatttctgaatgataatgtatatttctgcagaaacttagtatttgtttatggacacctgatcagaaagaagaggagatagctggagacatcattacgtgaggagactttaaatatgagactggaactaaagggggaaaattgttagtttatattcgtgctattccttagaatttgcaaggttctcccttaaattttgcttatgaattcttgacatcctgtgagaatggcagagttggtttttttttttttttccagttttacagatgacaaaatgataaggttcctagaagttacatggcttcttcaaggtcacaga

SEQ ID NO: 136928 - DNA, 2109 bp, Homo sapiens
tactaccgctgacatgagatggttcttttagggtctctgaggcaggtaggaggagtgggaacaatgattcctgttctttctacccccagaaactctgctccccttctccccttatagatacccatcgttctcattctccccctcccttgaggtgaaaacaagggctgtggcttctcaaggagtgttctcaagaggtttggcttgtagaggaacttgccagtagctgcctttatttgcagtcttctaacagggccttaatttctgcttcatctctccggtctgctggcccttccagcccccacctagttccctttatcattctgaccataactttaacttccatctcaccgtctaccctaagagtaggaggtaactataagccagagatcattttaatattttctcctccttgtactttgaacctctggaagtagttttagtttttctgttcctgtggcacgtgggtgggagacaatctaaatggctgggtgtgtgtacttcaagaactgattagctgtgggagaggcatgagagttgtttaggccattgaatcttggactgtgggatagaggttaacagaatgtggcaattcaggaggcattaaggatctttctaggcatcagtggatgtgaatgttaaatggtatagcttatctgggaagaagttgacattggttgctggctatcagtattggaggactagcaaaaagaaacttaaaaatcctgttggagctgtttaaaagcaataaaaatttttcatctaaccaccatgcagcataattactgtaaaacccttgacatacactggtccttttgtatgcttagcttccagttttgtccaccataacacaatgtggagggattattgcttggaaacaggtatccattggatacagggaggctggcaaccaagtagtaagttcttctgcatctgtgaccattttggtcttaaaataatcttttctctgacaccctatgatatagtgtgctaatgtgggacttgggctttttaaatgtttaaggttcatgcaatacattttgaagtattttgaatggagaaaaatgttcttttgttggtttttgccttataaccatactgctggaaactcataaatctaaaaaagagtaggtagctacatgagcctgtagtagctgtttacccagtttttctgaaacattaacgtatttaatagagtcaaagtaaagactattatcacattagaatgaaggtatgcatgtatctaatccgttttttttttttcttcttagactgccaaggaaatctgatgtggaaaggtgagtatggaaaaaaaaaacccttaaagtctctttattgatcaatctatgagtgttggtgtgtgggtatgggtggtgtagggctgtggattggaaacctaggcccaaagagtctagaatgatttttcacaccatgtatttagggagtcctgggaaatgtaatttcctcacccttaacaatacttgttgtgagaccagttctaaatcttctgttctacaaacctttattgagtgactgacctggtcaagtccctaagggtgatattaagataaagaaggtatagtctgtaaaggaagatgctgaggagcagcagactggctttagaaagttgactgccacgggcatagtggcgggcgcctgtagtcccagctactcaggaggctgaggcagaataattgtttgaacccaggaggtggaagttgcagtgagccgaggtcacgccactgcactctagcctgggccacagagcaaaactttgtctcaaaaaaaaaaaagaaagttggctgctaatttatcacttgcaacaatgatgctattaagtatctttagagagttgacatttgcctactgctcctactgttacatagttaacattttggttcagttggagcttggagcttaagatttaacttaaggctaaaatgtttccagaggccaaaggaacaagcgaaattaaagtttcaaagaaatcatttgatggagatttaaattgtaactaaagtatatggtacttgaccgtatctttggcactacttatgctccttggttgatttttttttttttataccaaatcacttggcaactttttagcat

SEQ ID NO: 136929 - DNA, 1036 bp, Homo sapiens
atttattgtctagcttcgttgtacaaataactgttactttaaaagaaagctaacagctggataagttgaacatgaaaatgggaaaccaaagaacaaaagtgaggtatggcaacccctgggactatgataggagtgtgtcgggggagggggaatcacctttgttagatcacatctttgcaccaggtggcagaaataattgggaatggaaaggagtaaacaaacaacaacaacaacaacaacaacaaaggtgacacttcacctctattacttcaactactactttaacttactaatttgtgttttctaaatttaataaaaaattgcattacattagggaacctggaatcatattgcatgcaggtagttatgggtggggaagaaaggagattaatgaactgatgcactggtgttgcaagagatgtaatttgagtccttcaaagaaaatgcttgacgtttttatcatggtgagataatgagacctgttattatagtagattctctgttcaaggagggagaccttgagagtggattttactcacaactgccatcagtagacaaataaaataagtgaatgttcatgacctaagtacaagtgttactcaacaaaattaatgaagtccaacaaatttgaaaccagtaaaagtcatctagagggtctcagtggatactttttattttattttattttgagagggagtcttgctctgtcgcccagactggagttcagtggtacgatcttggctcactgcaacctccgcctcccaggttcaagcgattctcctgcctcagcctccggggtagctgggactacaggcatgtgccaccatgcctggctaatttttgtatttttagtacagacgggtttcactatgttggccaggctggtctcaaactcctgacctcaagtgagtcacctgcctcggcctcccaaagtgctgggattataggcgtgagccactatgcccggtcattgattttaaaaataaatattttaaaatctggcatgccatgtgattagaatcctcagtcactaaat

SEQ ID NO: 136930 - DNA, 1052 bp, Homo sapiens
tctactaaaaatacaaaaactagctgggtgtggtggcatgcgcctgtagtcccagttacttgggaggctgaggcaggagaattgcttgaacctgggaggcgaaggttgcagtgagcagagattgtgccactgcactccagcctgggggacagagcaagactctatctaaaaaaaaaaaagaatgaggccattcctaaccaaaactctgaagcacgtagtttgtttctgctgtccttccaccttccttgactaccccacctacctgggaggtccatcctggggacagtggggtacaattatgagcaaccataggcctatgctgagggcctctggagaaactcacctcttcctccctctcctcttcatcacctggctgaagctctgggtactggcctcccaaggtgaacgtaagaaagaggctctcaagtgttggttgaaacttgaacacagctggcttcctgagctgagggagatattaagatgtgtaagatatttaactgttaactagggatctctgtagatttgtgtgaggaacaataacccaactctataataatctccaataaagctttgaaaaacaagaccagtaataacttactagtatcttgccctaatggatattaaaactctctataaagctattgtaatcaaaaaagtaggacattggagaatagatcagtgaaatagaataaagaagaaagaaactgattttatcagaacttaatacagtgtataataaaggtggcatttcaattcagtaatggcttatttaataaatggtgctagaataattgcctagcacatgaaaaacacaaagacaaactcctatttaattcatctttaattacagaagatacaaaggtaaagtaaaaaaatttaggagaatatttatgtaatatttagctaggaagaccttcttaaataacacaagaaactcagaaacataaaagaaaaaaaaagattgataatatagacaattaaaatttttcagttgcacaagacaccatgaaaagtcaaaggacaactaagaagctgtgagaaaatagtcgcaa

SEQ ID NO: 136931 - DNA, 1754 bp, Homo sapiens
tacgctgtaaaacattgtgaaatcagattactttcaaatgatgtattacaaagttatggaaaaaaagcagttgtgactatggaagcccaaggcttatatcccagctgtcttacactaaatatgggtactgtgtttcctctctttgtctgcaaaatgggagctaatatcctccaatctgtgtgcctgacatggtggttaaaaggattaagcaaaacaatagtttgtaatttattctgtcagagcaaactactggtaaataaataaaagggagtaagttgactaaaaaaatttttttataaataagaaaaaccataataaaacaagtttgtaatttgtaattgtatacaaataaaagatgttatttaaaaaaaaaaaagagcttcttttcagagaaaacaccaaatggcggatgacgccggtgcagcgaggagggtccggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatatatctcttctccctgcccattaaggaatcagagatcattgacttttgcttgggggcctctctcaaggatgaggttttgaagattatgccagtgcagaagcagatccgtgccggccagcgcaccaggttcaaggcgtttgttgctatcggggactacaatggccacgtcggtctgggtgttaagtgttccaaggaggtggccaccgccatccgtggggccatcatcctggccaagctctccattgtccccgtgcgcagaggctactggaggaacaagatcggcaagccccacaccgtcccttgcaaggtgacaggccgctgcggctctgtgctggtgcgcctcatccctgcacccaggggcactggcatcgtctccgcacctgtgcctaagaagctgcttatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgtcaagacccacaccagagtctccgtgcagcggactcaggctccagctgtggctacaacatagggtttttacacaagaaaaataaagtgaattaagcgtgaaaaaaggaaagaaagaaagaaagaaagaaatatagcctctgagccaggtgtggtggtgcacacttgtaatcccagctactggggagactgaggcaggcggattgcttgagttcaggagtttgaggctgcagtgagttatgactgcattactgcactccagcctgggcaacggaatgagaccccgattcttaaaagaaagaaagaaagaaatggattgtggaaaatcatgagctctcagatgtataaaataatgggttgctggctgggcgcggaggctcacgcctgtaatcccagcactttgagaagccaaggcaggtggatcacctgaggtcaggagttcaagaccagcctggccaacatggtgaaaccccacctctacaaaaaatacaaaaattagccgagcatggtggcgggctcctgttatcccagct

SEQ ID NO: 136932 - DNA, 1288 bp, Homo sapiens
gaggtggggtttcaccatgttggccaggctggtcttgaactcctgacctcaggtgatccacctgccttggcttctcaaagtgctgggattacaggcgtgagcctccgcgcccagccagcaacccattattttatacatctgagagctcatgattttccacaatccatttctttctttctttcttttaagaatcggggtctcattccgttgcccaggctggagtgcagtaatgcagtcataactcactgcagcctcaaactcctgaactcaagcaatccgcctgcctcagtctccccagtagctgggattacaagtgtgcaccaccacacctggctcagaggctatatttctttctttctttctttctttccttttttcacgcttaattcactttatttttcttgtgtaaaaaccctatgttgtagccacagctggagcctgagtccgctgcacggagactctggtgtgggtcttgacgaggtggtcagtgaattcctgatagggagacttggtaaatacagtctccttccagaggtcgggggtcaggtagctgtaggtcttagaaatggcatcaaaggtggccttggcgaagttgcccagggtggcagtgcagccccgggctgaggtgtagcagtcatcgataccagccatcataagcagcttcttaggcacaggtgcggagacgatgccagtgcccctgggtgcagggatgaggcgcaccagcacagagccgcagcggcctgtcaccttgcaagggacggtgtggggcttgccgatcttgttcctccagtagcctctgcgcacggggacaatggagagcttggccaggatgatggccccacggatggcggtggccacctccttggaacacttaacacccagaccgacgtggccattgtagtccccgatagcaacaaacgccttgaacctggtgcgctggccggcacggatctgcttctgcactggcataatcttcaaaacctcatccttgagagaggcccccaagcaaaagtcaatgatctctgattccttaatgggcagggagaagagatatatctcctccagggacttgatcttcatgtccttgaccaagcggcccaacttggtgacgggcatccactccttatcctcggccttgcctccgcgagctccgcggcctcggccccggccccgtccacggccgcgaccccggccccggatgccactgccgaaacctccgcggaagccaccgcggttccccatcccagggccaccagggcctccggaccctcctcgctgcaccggcgtc

SEQ ID NO: 136933 - DNA, 1048 bp, Homo sapiens
ttgggtcccaaggcccctaaatgactgtgcctttttctctctgcctttcagtcttcatatgcttattttacatagaaaatctagggtgttggcgggcgcgatggctcaagcctgtaatcccagcactttgggaggccaaggcaggcagatcacttgaggccaggaattcgagaccagcccggccaacatggtgaaaccctgtctctactaaaaatgtaaaaaatagctaggtgtggtggcacatgcctgtaatcccagctacttgggaggctgaggcaggagaatcccttgaatctgggaggcagaggttgcagtgagccaagaccgcaccaccacaccccagcttgggtgacagagtgagattctgcctcaaaaacacaaacaaaccaacaaacaaatctaggattttgagctgtacttagcaggaggaatagtacatttactccatcttctcagaagcagaagtcccaaaggctgccttttcacatttcatcacagccaagaaagtattactccactctgctctatgtttggatttggaaggcctttcctactgtaagggagtctatgttggaatggggaactgtcttaaaaaacaaattattgggccgggcgcggtggctcacgcttgtaatcccagcactttgggaggccgaggcgggcggatcacgaggtcagcagatcgagaccacagtgaaaccccgtctctactaaaaatacaaaaaaaaaaaaaattagccgggcgtggtggtgggtgcctgtagtcccagctactcagagaggctgaggcaggagaatggcgtgaacccgggaggcggagtttgcagtgagccgagattgcgccactgcactctagcctgggcgacagagcgagactacgtctcaaaaaaaaaaaaaaaattattgggtctaaagtagaacaaacttgaggccagtcgcagtggctcacacctgtaatcccagcactttgggaggccgaggcgggtagatcacacgaggtcaggagttcaagaccagcctgaccaacatggcgaaacctggtctctac

SEQ ID NO: 136934 - DNA, 1503 bp, Homo sapiens
gggttcaaacaattctcctacctcagcctcctgagtagctgcgattacaggtgcatgccaccacacccagctaatttttgtatttttagtagagatggggtttcaccatgttggccaggctaatctcaaactcctgacctcaggtgatccacccacctcagcctcccaaagtgctgagattacaggcatgagccaccacacctggcccccagatattttttctaggctgacctataacctgtatagttaaaaaaacaggatgacatcctgcatactgctttataacttgttttgtcatttagctatatattttgaacatcttttcatttgaataaatgtatcagtagtgttgtgggcagggtttcccaggaaacagactctgagacagagatttgtgtgcaggaagtttatcagggaatgctttcaggatcaacatgtatgggggaagggaatgaggtaggattagacaggaggagaagttagactgtggtgcagtatcaacaagggctccggctttgttgcttagaggccctgcaatgctgtcacaaattgaagaaagaaggctgggcctttatatacccgtgtcgtttgatgtgagctgcccctgggaaggggtgggggtgacattgagcaaggcagctgacttcaactgaattcaattcccagaggcagatgaagcctgtagcactcccagtagctgggagtcctgaagtgggatctgagccctgcagtacagaatccaccatagttagggacactattgacttcaaccagcagaaaacccaaccaccccttgtttcataaatagaagttagtctcagttaacaagccctcagtaggtgattgctagcatcaatgctatctatcccttttattaggaaaacaaaaactttctgagaaatactcggtagatttacctttacgtttcattggccataactaaaatgtccatccctaggtgcaagggaggctgcgaaagtagtatcagaattgtcaggattttgtgcctggagcagtgaacattgctgccctgaacagtgtccagattgttagtatagaagaagagcataaagggtattagacatgcaactaacaaaatagacttgtacaaaattagtttgaatagttgcatatggatttaacttactaaaacagtctccatattgctggacactcggtagtttccaactttttgctactatccaccgtactgcaataaacaccctagatatttttctctgcccattattcgttggggatgaaattgtaaacatataattgataacaacaaaaaaaccaggggaatggatctttgaaataattttgatgcagattaccaagaagtacctttgaaagtccctacaaattcatgttttctcctgcattaaaaaaaatttttgtttttgagatggagtcttgctctgtcgcccaggctggagtacagtggtgagatctctgctcgctgcaacctccaccttccggtttcaagcgattctcctgcct

SEQ ID NO: 136935 - DNA, 7148 bp, Homo sapiens
ttggaatataaacatgtagaaaatagtccatgacacagcggatgggttcataagtttcttccgggtcctaacaccgaattgtgctgatgatctggcaatggaggctaatcttgccacatcaagtacggcctattcgctaagccgtctggggcactttataatttttttctttgctggtctgtttgaagggctcctatggccaaaaaggtggtcagtcccgtcagctaggctgtgaggacgcctaaacgctttgaggacgcctaaacgctttgaggtagtgatgatgcatgatcgtgtgaaagagtttctcagagcacctccctcgcggggtggggaaaaggacctcactccccacgccccctccttccgctgcgggagatagccacaccttccccctatcggcgccaagcaggtggccaggccctcgggacctcgcgcccccgcagccagtggcccggccagctcgtgcgtcacgtgacgcgggtcagctgcaccgccgggacctccaggcaccgcggcggcgaccgcccagcgcgtggtctcgagatctcatctttccgcgcccctccccccacggtcccggaaaagggggaggccggtgacgtcatcatccgggttcttgtcggcggggctacggttcacaatggaacaaaaacaagcggcccgagtcaaactatgagcgacgcggctgcggctcacgcgattaaccctgtcgtggccacacaccccgccagtccctgccgcccagcccctcccgagtggtgtgccagatcttttcgggcctcccttccccaacttcggtcctagagccacctctgccctcgtcccgctcctgagccgaggggcatggaacaggatttctggccgtagcacgaccctgaaggggccagccggaagaaacagtactgcgcgaacaatctttaccgcattgtcttcccctcccccaccctagctctccgggttcccggcggctcgcgccgaagcccggccccctcagcggctcgcgctgctctcccagccttgacggcccggggtggagggagagaagagggggcagctgagcgggagggggctgggcaggagcagggggagggccgaaaggaggggcctgaaaggggcgggccctgacgggggcggagaacttcgggtcttgggcggctctggggctagtgggagtctgcgccgccgccgccgccgccaccgctgctgccgccgtcgccgctaccgccgccgccactggccgagcggtttttttttttttggtttgccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggtgagtggccagctgcactggggcgacgctctttcccggggccaacagctggatgtgggtgaggggaggagggcgaggggggtgtgcgtgtgtgcgagcctcttccctcggcggctgccggccaggctggggcttccccgttccccctcctccggcccgggctgggcgggcgcgcgggcccgtgttgtgtgtggagccggtgtcccgagagcgtgtctgtgtgttttggactgtaagggaaaatggctgacggctccgtccctccccctcctcccccttcccgtcctgtctggggccgagtaggaggatggagtctccgggcgtggcgggcagcccccccgccgtccgcacccgggggccgggtcggtttgggggctggccgccccccgcccggcggccgctttcctacccggtctggttccacttgacaccaaacgccattactgaggtggagtgatttggagctggggagctaggcctcggctacgcctggctatcaggcctgacgacttgtccgcctccccccaccctcccgcgataacccgcagtttctccccggccctgggctcctggagtgggagctgggttatcggcctcctacacctccttcgccccgctttatttgcagagggccaaagccgtgaaaggggtttttgaatgcagaaatcgcttccaagctagcttggacctattacctttctatttttaactgtttctgcaaatattagcatgtgcgagtttggtagtgatcaggtcttcagattcttgtgacgtgaggcttagggttggataaatggctgatttttcattcattgtgaaataagttaaagagttatacagcaggtgtgtagatggcttcttaaattatttgtgtggatttctgtagcgactagaacttacacgagaatttgcaaaatttctagtagaacctgcttaaattaagcatgttattttttggaagttccatagttacaacgttaattgaatttacacggtgcagtttacaggtgtatataattgcttcagattgtcttttagtttaaataagcaagttgtaggtatagattaaatattcatgctttatttttcggggagagaagtatgtgtactgttcttttacctggaaacccatgagtccctaaatctacttaacgtttgtatactttcacttttgaggaagaatgatttggggtgcattgattaggaaactttccagcaggtacttaaccctctcggagctgattacccttaggtaaggactccttaaccatgactagcttggctggttagtacacttgaactcaaaaatagagactataaactctcctttagatctcgctcgtcttctaattcgctgggctgccattttggtttcagcaaataccttcaaattcttgaagaattatgtattaaatataaaaaagtgtcaacattcgttttctcaatttttaaactcatgtgctgtgtcatacatctaactttaaccctttaaactttatcgttccagcttttgggtggagtgaaagcttgaagtatttggaattggtgttccacaggtgaactcaaaatgtctttggtattttactgttttattttctctaatttaaaaataggacgtttggactatatgaattctctctaccccttttcttgtatttttttgcatgaacatgtaacttgtaattctggttatcagcgttctcatgtttcttttgtttgctgaccttggtagtttctgagaatttctggagggagtaatagcaccagcaacagtacatgtgagaatcttaagttacttcaggaaggaacattgaagggcagattttacctttcaccaggttattggggtctctagtttggtgttccatagtccatagttctcatggttttgtttgtttgtttttttgtctgtcgcccaggctggagtgcagtggcacgatctcggctcactgcaacgtccacctcccgggttcaagggattctcctgcctcagcctccctggtagctgggactacaggcgcgtgccatcacgcccggctaattttttgtatttttagtagagacggggtttcaccgtgttagccaggatggcctcgatctcctgacctcgtgatccgcccgtgtcgacctcccagttctcatgttttatctatggaatgctcaagtaggatttactttagatcttttttcttccagagtcttgtttttaatatcttaaggtatgagatttctttgctatcttctcagagatttttctttgacatggtggtaataatgcagcttatggttttgaaatggatgtttgtcatgaatttgctaatcatccagttcttgattagttggtcacacaacaagtgtctttgagcttatttttatttaataagatcaatttctaacgttttagtttcaaaattttagtattaaaaccaatctttgtttaaaacagatgttaagaattagttatttgaaatatctagcagtgtgtgttaatggattagtgttcttctaagtcttttgggcagtgaaggtgaggggggtcttatcctgagattgagttagttgatttttattctgaaagaacgtattactttttatggtagcctacattatgtttcccctcttgtaggtatgttttctgagtcttgaattgtttttcttttttttttcaaaaagggaaaaaaccggattttagttgtcatttggttcttttaggagctgtgtttttgaaagccatcctgtgtattgctaagttcttgtattattttaacatagagtttaacgttaatatttgggaaagagttagtgcattggacctcaaccctgactggacatgagaatcacttggcggggttaaaaaacaaccacaacaaaaaaactgatccctgggttccacccccagagactgattaattggtctgatagggagcctgggcaaaggtatattttaaaagcattgtggatgattcttacatgcatttggagttgaaaaccactgggctattgtttttatcatgttgttagaactttcaagtggataaataagaaaatggatttttttctcaattgttttcagttattagcatgattatcatttgagcattaattgtctgtcagcactgttaagcattttccatttattgccttacgatgggtctgaggtctgtcaggttcaaccagtggtgcttcgactactgtgctatgttagtgaaatgacactgattgctatttttaaaaaagcatttagagcttttggtttgtttctcgtaccagagtaagttaagatatagtttagtttttaagactatcaagatagtctccaatttgataaatatcttggttgcccaagggagatgttaaaagctatgtggcaaataggtttctccccttccatatatcttccagcgtgctcagggtgatagtttagttggtgcgtttatgacaaaatattacacaacattcctaaaaggtgtagaaactatgcatttgtctcctagtaatttatttaaatgatcccacaaattaccgtttagtgtcacatgaaattctgttatctcagtttgagaatttagagttttatttgtcttagtcaaaatcagtttgattttgattaagcgttttgaattttgtgttgttttgggattgatgtataattgttttatggaacgaatgaaataacaataacagacatttatttggagtttctgtctcttaatccccttggtccattggaccaaattctgcatggtgggggcatggcagcagggaagcctataggagtttaggatctatgagggttttttttttttttttttttttttttttgagacagattctcactctgtcactgaggctggagtggtcacggttcactgcagcctccacctctcctgggctcaggtgatcctctccccttagtctcctgagtagccgggactacaggtgctcccatgcctggctatttgtattttttttctcttttatagagatgggttttgccttgttgcctaagctggtcttgaactgctgggctcaagctgtctgcctacctgggcctcccgaagtgttaggattcccggcatgagcgactgggcccggccctatgagcattcttagtgtgacacaagattccccaaagatctttttgttaaattatagaaaatgagactataaggatcatgaaaaaagttgatgtaataaggaaaaagacttaaaacttctaacacttacctatattgggcattgaatttataatttattgtggattataaagtgatgaccattgtaatatacttttaaagaataacttgtgaaaaagtatattgttaggatgagatcgcttacctaaaatttattcttcaaagatactcatgctaaatcttggtgtcttcaacgtgtgtatacacacatatcttatatttggcagcaaatggattttcaattttattctcaatcactgcctaacaaggattttctaccacctctgtgtatcaatcatctgtggagctttttcaaaatatatatttgctctataggtgagtctgatgtgtaaccagaggtttttttttgcagtcccttttagggaaaggggagaattgagaccctttgcatgtcatgtgttccaccattaggcagcagtactcttgtttgagtttcgttttgttagtcacacagtcaaaaattccagactgaaacacaaacatgtagtgaaaagctcaaacactagaagagacagggattccacactcacatgtattatatacagtatatgtgcacatatatatcaaatttattgtcacttagcaccttctcggtgttacggttccagctctactataaacattaatatctgttaagacatttgtttcctttttaatccgttcaacaaatacttctggggcatctgctgtgtgctaggcactgttctagagattactgttgtctagaagctaacatatgaagtgaggtgggctggactagctgatctctaaagtctttagtgctagttttctggcattcttttatgtacctcgtaggagagattggattaagttgttatttaaaaaaactttgttatggtatatgccaattgaattttttttgtcactaaatagaatttcattctgaactccagttttctccagtgagcccaaatgtcaagtatagtagaaataggttcttttggaattcttggcatactggctttaggaatagctgtacttct

SEQ ID NO: 136936 - DNA, 1518 bp, Homo sapiens
tttacttctgggagtcacttttcttactaatctcattacaatgagaaatcctggaagagatctcaattctttctagtcagacccttcatttttcagatgaaaaaaatggctcaaagaggtgaaaggtgaagtaacttgaccaagatagcatgccatagactaccttctttatgaagctatatctatatgtgtcaaatcacattaattattaaattctctgtagtcactcataaaattaacattaaactgtctccctggtaatggataataaggtcagggattctgtcctttacctttgtatattacagagcacctagaataatactgtttataataaccatttgattacctgaatgggaaaatctggggcagtatttaacttgcagtacctccaacctcttgtacagaattgattcatcttcattttatggcaccctacagtttattcttattaatcatgtgagctttgaacaccatgttagtcaaccataatcaaaggaattgttttccttgggatgagtttgagctggtgatcgtgcatattagatcccatcttctacagagcctgtgaattgggtggaaaggaaaaagggagtggcgaagcctcctgttagtatccttgatgtccattttattcctgctgactttggtggctattgagagttataagttgaggctgttggttacatctctcatttctagtcttttctgttaactggttacttagaactcctaagtaaggccgctcattattaacttggaccccagagagcatggaagttaccgtatagtattgaacccatttctgcctaacagtgttttctctctggtcgaggtgtagtgtacaaagttttggttgctctgcttggtaacatctctggagttcagagcacagggatcagtaaactttttctgtaaagggccacatagtaaatactttggactttgtgggctaagaggcaaaattgaggacattgggtaaaatttttattggtgaaataaaaaatataattaaatacagttatgtataacttaggtctaatgagaaaaacaatttggtgtgtgtgtgtggaggggaggtaatacagtattttgctttattgggtaaagttcagtgttccctgtcatcaaattgattgcagacgttctgtgtgaaatccattcttaccttgtgagctgtacaaaaacaggaggctggaattggtctgttaccatagtttgccagcccctagttaagagcagtgatttttttttttaagaggaggggtctcgctgtcactcaggctggattgtggtgacgcaatcatagctcattgtagcctggaattcctgggttcaaggcatcctcgcacctcagcctgccgagtaagtaggaccacaggccgacatcacctcacctggttaatttttgttagagaacaggggtttgactgtgtttcccaggctggtctcaaactcctggcctcaagcaatcctcctgttttggcctcccagtgttgctgggattataggcctgag

SEQ ID NO: 136937 - DNA, 2444 bp, Homo sapiens
ataagggatgctcaacctgtgccattttaggcaccagagggtatataaagatgattctctgctttcaaggctctgaagtatggtgaaccagacagttatacagtgcaattacagctgtattaagtggaggtgtgaaaagtgtagtaggagagatggagaaatcattgtttggcattgggtgaggtcttcaaagatgtcctattttcatggccctattaattagagcagggacttccggtcagagggatcaacttgagatcaggcagggttttttaaccctattgacagtttggggcagataagtctttgttgtgaggtgctgtcctactcagccctggcttctacccacaagatgccagtggtatagcccctaccccactcatatgtcttcagacattgccagttgtgccctgggggcaaaattgagaaccattatttgaaatggagcaatgcaagtgtgaaagtatagtgttttcagagtaagaactagtaggagagtgtgcaaggaacactagagatactgggaggggaggggttatgggagatggaactgaaaggtagtttgagtgaagctaaaatcacaaggggtaaccttgagtgccatgttaggacatttgccttttactgttaaggtaatgagagatgtactttgaagtttaagtgaaaggagacattagatttgtgtttgtttttgaaagataattctgatggcattcgtggcagatgtgttggagagttgagtgtcgggggattgagatggtattttaaccgttcttctgaaagataagaaataatgattagggaatggaataaaggaaggagatcaatggggtgctcccatggtatgagggaggtgctgctaatttgagtttggcttttctgccacagaatggagtactgagctaaaaagcaaaacacctctattgtcttcctttcaacttttcctgccacctccaattccctttcctcactgagagctgctgtctgttgaggtctgttgaaaggtcattgagagaagggaatctgggttacagaatgactactctctcaatgtggttccttaaacagtggattatcaaagcacaagtgtcatcttcccccccgctccccgcaaggggttagactggcatccagagagcattaattgtagcctctccttggtttgtgtagatgttattttgccctaaaatactttgatatacaaacataggtgaataatctgatggtttaattgtaattatttcattgcttcctattttggaggttagctttactattttaagtgagaatgtagtcagtggaagggtactggacttggagtcacaagatctgtgttttatttttttattttattgattttttgagacagagtctcgctctgccgcccaggctggagtgtagtggtgtgatctcagctcagtgcaacgtctgcctcctgggtttaagtgattctgctgcctctgcctctcaagtagcttaggattacaggcaccaccacccacggcgaatttttgtattttttgtagagatgggattttactatgttggccaggctggtctcaaactcctgacctcagctgatcagcctgccttggtcccccaaagtggtggaattacaggcatgagccaccgcgcctggtcaagagctgtgctttagttccagttacccaactccctgtgttaaatcacttagctaacctcttgggtcttcatgactctgtaaaaccaagatgttgggcaagaggtgagttaaactactacttttttaagttcttaaattttatctttattcctaaagatgtggaaaaatctgtagtcaagagaaattgtcaagtaaaggaaaacagagaaggtaaacactttaatgggtttagaagttggttatattcctccatttacttgtcaatccaacaacttgaatgtctcctctcccttgtttctcctgtgtggtctgaagggctttattttatttagaatcctgtgggttaattgtgcttggcccacagcttgtactgtgaatttagggaccatagactttgtagccaggggtataatttctttgttggcagagcaacttaaagtttggttaagttttcatctgcagtctagtgctttaataacataacttgctaaaaagtgatatagcctgctaggggaaatagtatttagggggaaattattttttccgaattgaagatgaaaatacacagataaatacagtaatagtgatttttatctggcacagatggtttcagagaaaatgttgatacctcatttcttattttactgtaagagaactagcaaaagaagcttattttgtttcttaggtgagtcattctcaaacttggtctcaggatgcttttatactcttaaattattgaggatcccagagagcttttgtttatgtggggttacagccattgatgatttactgtattagaaat

SEQ ID NO: 136938 - DNA, 1258 bp, Homo sapiens
cagcactttgggaggcttaggcgggtggatcacgaggtcaggagttcgagagcagcctggccaatatggtgaaacccagtctctaccaaaaatacaaaaaaaaaaaaaattagccgggtgtggtggcacatgcccgtagtcccaggtacttaggaggctgaggtaggagaattgcttggacccgggaggttggctcactgcaacctccacctcctgggttcaaacagtctccctgcttcagcctccctagtagctgggattataggcgcccgccaccacgcctatagcaaagatcgcactactgcactccagcctgggcgactgagcaagactccgtctcaaaaaaaataaattaaaaaaaataaataaataatgactttagaggatacttcttctcagatctttcttagtggaatttgtgtatgtaaaactattacagaaacaacccaaatgtccattgtccatcaagtgatgaatgcataaataaaatatacaatggaatattatctgtcaatgaaaagaaatgaagtactgatacatgctacaacttggatgaactttgaaaatgttatgcttaagtgaaataaaccagtcacaaaagacctcatatcacatgatgccatttatatgaaaatagattagcatgggactgaggggaggttggagggaagggagaatgctattaatggtatgaagtttctttttgggggtgatgaaaaagtaatctgagatcgattttggtgataattgtgcaactctgaatatactgagaacctttgacttgtacactttaaatggacgatttgtatggtatgtgaattagatctcaagggtgttattttaaaaaacttaaatataatttataatgataatctcattgattaaacataatttgaaattttttggtgtactttttcagattctttacatttatgatttaaccaatctggttttggaagatacaggcagaaagaacacccagtggaggcacataaaaaatgttactagactgggtgcagtggctcatgcctgtaatcccagcactttgggaggtggaggtgggcggatcacttgaggtcaggagttcaagaccagcctggccaacatagggaaaacctgtctctactaaaaatacaaaaaattaattagctgagtgtggtggcacacacctgtaatcccagcaacttgagagggtgaggcacgagaattgcttgagcccaggaggtggaggttgcagtgagttgagatcacgccgctg

SEQ ID NO: 136939 - DNA, 1022 bp, Homo sapiens
tcggaacttcacagcctttgtaacgatttaaaaaaggagttaagaaaggtgttttctttttaaaataagtcttttcgttttgatgatatttttcaacattagtacatgcatttttggattatccagatgactgcctcataatcaagaactgttaacatcatttcggtacttatgttagcttaataatgtgttggtgccaagggcaaatgatgtcacaggatactatgtgtatagagtagtgtaatcattcaggtagaagtaggaacatatgatggtggtatagccatgcaaaactcgaacccatgccttagcattcagtaatacactgccatctgtcacgttatattaatagttttatttgtattccatttataaatttattttagttttagttatgagagcagtaagcataaggaatttaatcctaatttcatttctgcatttatttaagcaacattaaaatagaaagtgattaaattagtttttaaaaattctgttatgatagaaccagaatttgcaagcttgagccagcttacttaatattattgctggaaacctagcatttggcattaggtgactggaactgggactgcagttttgtatttactaggttatttctctatttatgaaatgggaaatatatttctaactaaaagggtcgttcatttgttcattctttcactcaacagataattagttgtgtagcaccacataattttatctcattactagtttaattttccctactgtcaaattttcttcagagccagcacaaaatctgataggaatattatgctatgaattgtcttctagaaggtaagataccacccccactcccccttttttgagacaggttctcgctctgtcacccaggctgaagtgcagtggcgtgatcatggctcactatagccttgaactcccaggcttaagccatcctcctgtctcagcactcccagtagttgggactacaggtgcatgctaccacgctgagctaatttttgtattttttgtagagaaggatt

SEQ ID NO: 136940 - DNA, 1425 bp, Homo sapiens
tttttaaaaaataggacaaaataattttaaaatgtggtaggattctgttgtaatgcaatggaataacagctatatcagtaaaactgttgaggctgttcatttatttaaaaacctaagcaattgtggtgtgtataccaggagcagcaaattctgataatttatagttgggagaataattttcctctgggctggtctagagattatatttatagggaccctctgaagattcaaaaataagaattgtcaagaggggataatcagcatttcaagagaggaataaccagcacttgttaaaacacctgctctttactgggtccctctgtgtgtctggtacttcacatacattctcctattaaagcttttcaacagtctctggaggtattagccatcttgagagagaaaaaaaaaagatacctggagttagaacatcatctgttgtcggcctgtctgctatgttgcagtatatgcattgttgaaaacctcatagtctgcaaaaatcaggtaccaaaaactaacaatgtgtatagggaaaaatgggcttaagagtaaactgatcacttcaaagctatgttactttgtaattagagcactaacaaaacaataaaaattccagtaaaatagcacagttttgaagatcctaaatttctgacaaactacaataaatataggacttgaaaaaggtagcttgatggaaggggcaggtataagggggagggttggggtgactgacttagagagacaaagctaagatgcataaatatcaggtggaactgcgtacatacttctgagacagagcatgtggcctgactaagccaagaagaataatgtggggctaggaggtggtggtgatgagcatctggttcagacctataacccccaaccccatgctgcattcagcttctgttacttgtgggtacaaaacatcaatgtgttgggggaaaagtggcaaccactattctactttgtgaatttgacgactccaggtacctcataagtggaatcataaaatatttgtccttttgtgaccgctttatttcagttaacatagtgccctcaaggttcatccatattgtagcatgtcaaaatttccttgctttctaaagctggattattttccattgtttgtatgtatattttattgacacattcatctgtcaaacggatacatatgcttccacattttggctattgtgactaatgccgctatgaacatgggtgtacaagtatttgttcaagtccctttcagttcttttgagtgtatacccagaagtggaattgctgtatgtatcatatgtaaattctgtgtttaactttttgaggaatcaccatatgttttccacagtggctgcaccattttacatttcttccagcaatgcacaggggttccagtttctccccttatccttgctatcacttgtgttttct

SEQ ID NO: 136941 - DNA, 1142 bp, Homo sapiens
tgggggagattttttgcaaagttctgatgcctaggccttactcccagatactgtaatttatttcatctggagaggaacctgggcatcagtgttttaaacaaaatcacttcaggtgattttattgtgtagctgaagagggctactgatctaatgaatatagaattgaggatttggtagcattctcctgtacttgtttgctggtcagtttgtaaagaagagttccctgttcttaaacagttgtggccttgtaaccctgttatggctctaggagtggctggagccaaaaccttgccaaagtagagagctgagatcatctgacaaattcagttgtattggagtattatgtagtttgaaccctcttaaaattttaccagaggtttttggggggttttcagggttttttgtttgtagggggtggagagagcggggatcttaacagaaatttgttctctcacaattctgaaggccagaagtccaatatcaatgtgttggtaggtttggtttcttctctggcttgcaggtggccacctttttgctgcatctttacgtggtctttactctgtatgcgtgcacccctgatgtttctctccaaagcgtcaaagtttatgttaaaagtacttagaagctagtttaaaaaaccatttataatgccctagtatcagtgataaacgttagttgtgcggcctgccttgaaatgttttaaaaaatcactttgtactttgtctaagtacacatgttactgaaacaggagagttccctgacgccctcacaggatgtgtgacaggggtgtggctcatttattcctcttatgggaaggggagcacacaggtgagcaggtacaggagccagggtgagcgcttttgggctccggccccacagcagtgtctaggagtgttacaatgctcctttagccctgctgtcccagcataagtgttaaacagctcagagaagagtcagtgtgacagcctttttgggtttctgcatttagggcatcccgagttcttttcctgtgtctgggaagaatcaggtcacagggacttgaaggatggtgaatgtggggatgttattgagtggtggaggtggctgtcagtgggatggggagctggagaggggatggagtgggaagatgatcttctcctgga

SEQ ID NO: 136942 - DNA, 1209 bp, Homo sapiens
ggcttggggtttatatgggcacgggataggggtgcgtggcaggccaaaagggaacacttgggcgtgaaaacaggaatgcctgttctcatttagggctgcaggtccaggcttgagccctcaccagggaccccaccctcatacctcttgtccttattcttacagtgtaatgaatgcatcagcaaattgaaaacagatagtttttgccgtttcttaatttaattaaaatgacagttaagtactttgatatattgcctttggagtcatttccaggaggctatatttgtttgttttcttggtataatggccagtgtaccaatgatcagttttaagttaaatgtagtattaatgaaacttcagctttttactttctcttcttgtttgtatagcccctttttcctgattagattcactggtgatactaaattcgaacagttccataattcatgttttttatatctaaaaccaattactttttcccctttctatttgtaggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcaggtaggatgttgaagatactagttaaagctacagtggggctggactcagtggttcacatctgtaatcgcagcactttgggaggttgaggcaggcagatcacttgaggtcaagagtttgagaccagcctggtcaacagggtggaaccctgtctctactaaaaatacaaaaattagccgggcgtggtagcatgcacctgtaatcccagctacttgggaggctgagacaagagaattgcttgaacctgggaggccgaggttgcagtgagctgagatggcgccaccgtactccagcctgggtgacagagcgagtctctgtctcaaaaacaaaaacaaaaaacctacattggtgggtctactgttggggtactaaatgatggaacatgttctaaataatttgtgaagcaactgttattttaagttttgattaacaaaagtgaacacgttgggcgcagtggctcacatct

SEQ ID NO: 136943 - DNA, 2112 bp, Homo sapiens
gttgtcccttagtattcatggaggattggttccaagacctcttaccacttggatagcaaaattggtgtatgctcaagtccctgatataaaatggtttagtatttgaatataactcatgcacatctttctgtatatacttcacatcatctctagattacttatgatgcctaatacagtgtagatgctatataaatcattattatgctatattgtttggggaataatgacaagcaaaaaagtttgtacatattcagcacataggcaattttttctgaatattttcgatccaaggttgttggttgactttgcagatgcagaacccatggatatgtagggctatttacaaaatttttaaatctgcaatgcttgtctatgttggtgtttggattactattttacatatgttatagaaacttaaatgtggaatgtttaatttttaattaagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggtgagttggtgtgtaacacccaagaaagagagcagacaggaaagtaaccccactgcctccttaatagtctttatagcttcgtcactgccaagtgctttataacccatgattcttaatagatttaataaatgaaagggagtgacagtgttagtaaaaatttcacattaatgatgatgaccctagttgggttgtttccgaagtaaaattgtatgttcagtttccctcttggagagtttatgaagtttttttctcattggtctcttggttgctggatgactttcataatttttgggatggcctgaggtaaatcaggtcatgaggacattgagttcctcagagcctgatcctagtgaactcttgactagtttgagctatttaaccatcctagatgtttcctttttttggtcttcatctcagggaacagttcagaatataatttttcacacttatagtacaaacaaccaccctatcccaccccacacactttgattatttagaggaaacctccaagagagtgaagctttaagcttttgtgcagaggaagaaaaagatttcaagaggctagggaagagcacatcaaggaatcccatgtgactgtgatcttcaccagactgtgggctcaacaagtgagtgctaggaaggtgcgacacatttccccctcactccccaaaaggaaagtaatgaaaacacatgttcttaaaggcacttgctttactgagtttttttttaaatttcattttctaaaaataagtcaacactattaaatgcataatgtgaggggaaatagaaatcctttgcattaaaaaaagaaatctaaatacataaataatgagtatgcgttaacagaaatattttgtgtaggtaaatttctctgtaatttcccccttacatacacatattcctgccaaaaattactgttaacaatcaatacattcttcagattacctttgtgtttactatcatatatgaattgatttttctataaatagaggattcttactataattttgtaacttgctttcatttatcttgaatatttttcctattaataaattccattgtttttaattatatatttataagaatacattgtgtgattctggcaggtgcctatagtaatggtatataataaattatatttaatagtggtccctgaccattctctatagcagtgataccatagcagaaggttgtattgtttgttgcttttccatacttgtctggtggttggtgattggtaataaaatacttcttaggctaaagttgcatattattagcaagttctcaggggggagaaaaatacaaatgattttttttttctttttttctttttttttttgttttttgttttttgttttttttgagatggagtctcgctctgtcaccaggctggagtgcagtggtgtgatctcggctcactgcaaccttcgcctcctgggttcaagcgattctcctgcctcagcctcccgagtagctaggactacaggcacgtgccaccatacccagctaatttttgtgtta

SEQ ID NO: 136944 - DNA, 1016 bp, Homo sapiens
cactgcaacctccacctccccggttcaagcgattctcctgcctcagcctcccgagtagctgggattacaggcgcccaccaccatgcccggctaatttttgtattcttagtaaagacggggtttcaccatgttggccaggctagtctcgaactcctgacctcaggtgatccacccgccttggcctcccaaagtgctgggattataggcatgagccaccgcgcccagctaatcttttttctttctttctttcttttttttttgtagagacagactggttccccaggctggtcttgaactcctgggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataactttcaattcattttttaagatattgcagattaaaaagcagtaacatttcattttctgaaataggatagctatggatgtgttataactaacagtaggcactatcacaattgaaactgattattgtcaaaattaacatgtttagtactttaagttcaactccatggcaagggaaagtttgatttatcttttaataattcccctcttttgtttaaagaacgtgtccttatgcctcattaatcttgtagaaataatatcccaaagtgaaaatacaatacgcggacaggttacagttgttttcaccactcagaattttttgttcttttatacgttcactaattcatcaaaattttttaaagaaaatatctttttttattttaaaaatgttgaatttttatgggtatatagtaggtgtatata

SEQ ID NO: 136945 - DNA, 1469 bp, Homo sapiens
cagaatagtataaggatattgatgctaaatgaatgatttatgaacaaaataagattttaaaaattgggaaatgcttttaaggtcaaagacttattttcagggagcaaaatactatttaaatttgcctcttcttgtggtgctgctgatcaccattttgtgtttaaggctagtgccataatttgtaacattttcagttagtgttaatattactcggttaatctacttttatgcaattaaatatttgttagctgtcggtgaagtttccagttatttattaccttttattgtatattggacaatgtaaaaacaaccagatgaacattttgtttgcattaatttttctccctttttcttaggccttgatgttaaaagtgaagcatgtcagcgatttttccgtgatgggctaacaatatcattcactaaaattcttacagatgaagcagtgagtggctggaagtttgaaattcatgtgagtcttgcatttgactttaaaggatcagatttacatagtgatgcctgtgagtgggaagaggtatatgtgtgtgtggctgtgttatatttattctgttataattgaattaaaaggtctaaaaatgaaaaacttaaaaatgtttataaattaagtctcttgaaggccgcatggtcatttagaataagcatgagatttagagttaagcttgggtttaatctctcctctgggatctcaagtgtctgtgaccttaggcaagtcatcacatttcattgaaaatgtaatgctatcaattgtaaggtacatcactgttttatggactattaaggaagaaaaacacccaagatggggcatttcatatacgtctgggacaccaaagggtcagtatagaggtaaatgagaaatgaacttgctatgcagaaagggacagcaaaaaatcctgcatatctcaaccttggcacttggtggagggagggattaaaaaaaaaagtgaaaatctaaaccacaagccagtatttaaacagtttcgtagtctgaattcaaattatagttgcaatacaaaaagcccttaagtggaaaatgtaaagtggtctcatgtcggtagtgcccccaagtgactagcagaagcaaacacaattcctctctgcaaataccttccatttaggaaaacagtaatgtattgttcattgattataagatagagtcagattccagagatcttaaaaagtgaaaaaagtatatgtctcagactgataaaatgccataactactctaagtctctgttgcttttgttttttgtgtgtccccccgcaagacggagtctcactctgtctcccaggctggagtgtagtggtgcgatctcagctcactgcaacctccgcctcccaggttgaagtgattcttctgcctcagcctcccgagtagctgggactacaggcgtgcgccaccacgcctggctaatttttgtatttttaggagagatggggtttcaccatgttgg

SEQ ID NO: 136946 - DNA, 1461 bp, Homo sapiens
ataggtgtagaaatggaaactttggaagtggcgtcagacttctgcatttgacatttagctagcaaatttatcttggatgattgacatattgtttattttatttatttttattttttgagacagagtcttgctctgttgcccaggctggagtgcagtggcgccatcttggcttccttggagcctctgcctcctgggttcgagctattctcatgcctcagcctcccgagtagctgggactacaggcacatgccagcacacgtggctaatttttgtatttttagtagagacagggtttcaccctgttggccaggctgatctcaaactcctggcctcaagtgatccgctttcctcagcctcccaaagtgttgggattaacaggcgtgagccactgtgctcagcctgacatactgtttagactctagaattgctgcctctcgtgtacaaattccacagagaaaaaatagtaacttgcatcttacctgtggacgtagagcaggaatagatatcttatggtgcctcttgtattttttaagccatagcaaatggcttttgaaagtaccatataaattatgaagtaaacaaattctaatttgtcctttgataatcagtttgatcccaatattaatgattagaaaaatggagagatcgttatttgttaggatacgattaatattggaagatatttctgtttgaaattgcagtgttttgatcttgtaaatcgcctttcccccttgtataacagaggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaaggtgtgttggtttgttattttcaaaattaaataatacaattgttttgttctgacacagaatcttcagtgatctgtatttaaagtgtgacaatgaaataacactttaaatgaaaatacacacaaccaggagcctttttcgtagctttgtcgttctagttctttgttttttctgcatgtataattatccccattgtcttctgtccagcctctttagaagtagtcataatttgggttagtaggaaacagactgtattttttctttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactg

SEQ ID NO: 136947 - DNA, 3759 bp, Homo sapiens
cagaccttagtttttaattgacaattgactctcaggctattagttactgtgtttatagggaaattttaatgttttacaactaaacaagaagtagattcaaaattcattaccaagtagcttcttcttaactctcttgaagtctttctgcctcctgaaaattattttaatataaaagactttacagtaattagaaggtattcattcttatatggtgggatatctgaaataggagcatgtcttctaattcctgttcaccacttacattggtacagacagacagaactatgccccagtgatttaatctatacttactacgtatactgcttctgtctcacagatggaattactatgaacaaaatgcaatgttttgtggtcctttgaaagatgatttattttattgaatttactatttctagtatatttcaataaggcttttttttcgtgctttttaccctttaaagtaggaagttaacttttttcattaattgtgttacagggttggctagtggatcttctcaacaaatttggcactttaaatgggttccagattttgcatgatcgttttattaatggatcagcattaaacgttcaaataattgcagcccttattaagtaagttacatttaaaaatcaatggttagtgcaccgtagaattgctggtttttgcttcataaaaattgagtttttcaagtgtggtttcttcaactaataactgggattttttaaaagtaatataaagaatttagtcctaaattgattttaagaaattgcgtatttacaggagttttgtatctttcttatttcagaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttaggtaagatacttacctcttgaaataattgttaatgccgattttagaatcatacttatcactgaatttttcttacagattattgcaaatttcttctttcaatggaaagatgaatgcactgaatgaagttaataaggtgatatctagtgtatcatactatactcatcgacatggtaatcctgaggaggaagagtggctcacagctgaacgaatggcagtgagtctttcagttcttcttcataggaataagaatctacttaagacaagaaattagaatagctctagctaaaaaaattagtaatagtaacattttaaagtaaactgaaattgggaggtgttttgattgatttataactctgttaatcctgagaactttttgaaataacatagtttattatttggtagtgatatgggtagctttaaaacatctttgataaacttagtgatgaatgtggcgttttgaagtaattattagtttgttggagagtgggaagttggttgaaatggagtaggtagagttgatctagaaaatggattgggtagtatctagtaccttataaagtggcctattgttcatttgaccatttacagttaaacgttttaaaacaggaaataaaattactagaataagatctatacaaattgttttatcacgattttgagaattttattttgaaagcccttattttgacattgaaattttatgaaactttatgtaccatagctattttgtattatattgttttgaaatgagtaagtatgccatttaagttacagtgccaatattttttgaatgtatatgtgtaacagtcctggggaaacatctgtaggagaactgtccttgccctcaaggagccctcacttaataggggagttagtgattagagtatgttaaaatgcatgtggagactgcttagatattgccctgtgttagggggtcaggtggtagacatctggtttcatacatatgatgtacgtatctgcctcatggaaagtccagcacagagctattcaaagtgtgctctgaagactggtgctggttcttgaaccagtcctagataggacagagaatggcattaagtgtttagaaactttcattgcagtttgacattgcgacatttttattgtgttttacaaaattatctgtggctctgcagtggctcacgcatgtaatcccagcactttgggaggccgaggagagattgcttgaggccaggagtttaagaccagcctgggcaacaaagcgagaccctgtctccatattaaaaacatatgtgtatatatgtagaataacataaaaacaaatatctgcaacagattagacattaaaaactggctcattatcagctgagacatgtacttctctagcacattttgggcctaactactttttattctcagctaaatactgcaaaatcatatagtgtggattactccctgtttgtatcatgagttagcactttattctgttgctatagattaaatgaatgctagttgagcaagctagcacagtgttacagaaaaacagactgtggaagcatatgacttgattcatattccaattctagcatctgtgagcctgtttacattttgtaatagaataatgtatctcttactaggattgtttggaaaattaaagagataatggataagcaataatagtgcctagcacatgataattgttaataaataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaactacaactccttctattatcttaatgac

SEQ ID NO: 136948 - DNA, 2023 bp, Homo sapiens
tgtgccttatttttgtatttgcaatattaaaattgtcaaattaaataaattgtattaaaggtttgtatgaaccgccaaaatacacattagctgtatttattatatcatgaaattaagttgccaggttttagatggcagttctaaagcattttataatgttagaatttttttttttttttttgagatggagttttgttctgttgcccaggctggagtacagtggctcgataccggctcactgcaaccttggcctcctgggttcaagtgattctcctgcctcagcctcccgagtaggtgggattataggcatttgccactgtgcgggctgtgttaggaattttcttgtgttacatagttaaatgaaggagataggagtactttattaattgtcagcaagcagtatacactacttaatctattactcagattcttgtgcattgtgatttcgtttttgtttttcaataggcagggaaacatgaagccattgtgaagaatgtacatgatctcctggcaaaattggcatgggatttttctcctgaacaacttgatcatctttttgattgttttaaggtaattgttaacatagcaaaatattaccattctatttcaaatagaattgattaattagatctgtgaattacttttagccaataaatacttaaatagaaatcccattaaacagtctgtggtgtgaaggaattggcccattgttttcttttccaacaagaacttgatgttcattttcttaatagcccccataatggaaactcaggctatcactttttctttctttcccctggtagtttctattttagttacaggttcaagcaaattgtaggactacagggaaggatgattggctacaataaacagtaagatgaaagcaagagaataccaatatcttggtattctggggtcatatgtacaagcaaaatatgagttaatcaaaatgtaactgataaggtagcccaagaactcctcctacagtcatatctgcattgatgccatcatgttggtttttgaggccatgttttgtaacatctttgattagttgccagggttaggtttgtgaaagctcaagtggttagtgaatttgtggattaagaacgtaactttttggcagtttgcactaagaggtgttctgttaacaactggcattagatcaataggtcaccaacgtttcttgttaaaaataataattatactgaccagtgggaacataaattgctatagccactttggaaaatacttggtatttctggtaaagtttaagattctcataactcatcagtttgacttctgaatatacacttgagaaactcatgcttatgtacaccaggatacgtgttcagcaacacttgttagcagaattacttgtaatagtgaaaaaacctgctatgtaggatagataaaacatagaatagataaattatggaatgttcatacagtgcaatatttcacggcaatgaaagagcaactcaaccatatggatgagtctaataaacagaaggttgaagaaaggaataaagccacacagtaattaatacaccttgattacattaatgtaaagttccgaaatgggcacagctggtttctgggatgttacttgccgtgtattattttttacctgggtactagttacacaggtgttcacattgtgtactgtaataatggtatatgcttgtacttttctagatatttcacagtagaagaaaaaaataccatttttactggcttccatcacagacatgttagatcagtaggtactgaagcccaagagtctgtattttaagcaagtttcacagataagtcttagggacattaaagctttgatttatggaaaaatcgctgccttatggaaaattttattttgaagggaacaaattattgagtgaatcttttatgtggtttttatatattttgtttctatacatgtaaaagcaaaacttaaatactttttccatccattgaagtatatcaaaggcagctgaggaaataatagaattggtcatcatgggcactg

SEQ ID NO: 136949 - DNA, 1217 bp, Homo sapiens
agactgggtaatttataaagaacagaattttatttggcttatgattctggaggttgggaagtacaagaggcatggtgccagcttaaccgtgagttttgggggggacattcgaaccatagcagtaactttactcataaaacttttcccatattgcttagcagcatccctggtctctactcactaaatgccattagtaccctgcccttccccaagcatgataaccatgttgtattacaataccattttagaggttttaaaaaaatgtattttagagtttttaattgggtgtcttctaaattgaaatagtgtatcatttatttttcttttttggaatttaactctaccctataaaaaaaataccaggctaactatattttcagatctcacttgaatcattctgtgcttagctacgttgcttttgatgaatttgaatatagttaacctggtgacaatttatgaagtggtgactaaatatgtgttgttttcatgtcacttaatttttttctaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttccggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaaatcacacagtttccctacattctaatttgtggcatgtgtattttttaacacatggtaaagtgaacattgctgagtaatttctcacatgtt

SEQ ID NO: 136950 - DNA, 1784 bp, Homo sapiens
tctttattttgattttggcgattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttggagttctggtagtaagtgtgaaataaaaacaaacttaaagcttttattatttaaattaaactctttactgtaattacaacatgatgcttgtattgctaatcttaaaagaaaagcttttattttataattctcaaaataatttgaaaataaaattctcctgagtattgatctatttaaaacattgaaatcatttgtttaaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgaggtaagactttttaacatagaaaatttcaatacttaaaatttatgtactttattgaaaagaaacagcatattggctggcaaatgcaaatttttaaattagtggagtgagaagaggctatataagaagtgtttggaacaaaagaattctttattacatctacctcctttttttttattaatgaggaagtaagccacagttaagtgataaatcagaatcaaggtaatattgcctttgggttcttggttcagaattattattatatacatactatatttccagcaagtatgccaagaagtttcatagcatgtctttaaagatggattagaccacaagaacatttaaattgatgaaacatgacaagataaagtttcataatttttaaacatttattttagctaaatttctttttaatagctgtctttatactatcttaggtgtcatattctggttactgaaataatttgtcctattttctggtaatacagttggaactgataacatgaaaaggaaaaataatgtgaagagaaagagagcagggtgcagtagaaggaatattcacagtggagtcaggattcctaggtgtgaatcttgtgtcaaaccagtaatttaatcttgtaaaaattctgtaaagaatcatgtttggcctggtgcggtggctcacgcctataatcccagaactttgggaggccgaggagggcggatcacctgaggccaggagttcgagaccagcctggccaacatggcgaaaccccgtctctactgaaaatacaaaaattagccgggcgtggtggcatgcgcctgtagtcccagttactcgggaagctgaggcactagaatcgcttgagcccgggaggcagaggttgcggtgagctgagattgcagcactgcattccagcttgagcaacagagtgagactgtctcaaaacaaaaacaaaacaaaaccaaaaaacatgttttctttatatgtaagattaaatgattgccaggatcctttacagctctagattactatgattatacctcagacagaaatagaaaaggtcatgtatatgtctttatttaaacagttgaactttgtctcacttttttccctaaggctagaaaaaattagcaaattggaaaagctatag

SEQ ID NO: 136951 - DNA, 1073 bp, Homo sapiens
caaaacagattagggtttcaatgaagatagcaaaacagatgagtctttgtggtgacacctgtgggcaaacttggctacaaacagagtgtcccaggatgttttcttaaatagctaataagaagaaaatgctaagagcattttctttgattgaattcttccttacaactgtagcataatctttgtgatgctagtcttgcaaaaaatgtttctattttataattttgggaataattacataacataagtgctttggtacagttatagtatagacattagtcattgaggtatactcccatttggtgaagttggagaatagtgatggatgctttttgtgtaaaataataatgtaataaatgtcttatcttttgaagagtttaagttggttgtgatattttcattaaaagaagtaaatgtacaaaagtataatttttaagtttttacatcagtagctaagaatttagatagtacgaactcttctggttacaacagagtttaattgcctaattatattgttaagttcttctcgtttcagtcaaactcagcgaagtccccatgtgttttatcgccatgacttaatcaatcaacttcaacacaatcatgccctagttactttggtagcagaaaaccttgcaacttacatggaaagcatgagactatatgctagaggtatgtattgtaagctaaaataaactatgggaaatagcagggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcattttcaacctttatgtcctttaccaccacctttagctttttaaaaggaaacttgttttgtctaagtctgttcttactttatagttcttttataatgccaagcctatgttttgtaagtgcttcaagac

SEQ ID NO: 136952 - DNA, 1099 bp, Homo sapiens
tcttgctctgtcgcccaggctggagtgcagtggcgccagctcggcacactgcaacctccgcgtcctgggttcaagtgattatcatgcctcaacctcccgagtacctgggattacaggcacatgccgccattcccggctaattttttttttgtagaaacggtttcgccatgttggccaggctggtctcaaactcctgccctcagatgatcagccctcctcagcctcccaaagtgctggaattacaggcatgagccactgtgctcagccatgattccatttttatatgaaatgcctcagacttaagcagggagaacaaagggagagggtggtttgtacagggtttcttcttggggtgaggaaaaatgtagacttagattgtgatgatgattatacaactgtactaaaaaaattgaattgtatttaaatggatagattttatggtactttatgactcgatgttttttttttaaatgaacttttaaaataagttctaaaatgggccctagaaaacttgctgtttatgatgacaagaaccaatttatgttagtctcagccatgattcactacctcttcctacctattttcatagacatctgagtaatttagtctcatctaattcttcctgctgttttcagcgggatatttgccacctagacaatatgagtcaaaagtggattatcctcctcatttgactgctagctaacaagtccaggtatttgttttgaactgaatatttactactaaactaccaatttatatatatacatatatatatatataaatttgtcttgacagcttggaagcttctctgtagtaagagggcctcttcattcctatttagcataaaggcatcttatttcttgacttttattgattagctgtcagctgaatgtttccaaagttctactctttgtgcagggtcccagttcttcataagtaaagtgttagcacctaaacaaaaaaagggaggtgggttgttagctaaaactagtgggcaaaagtttaacaaaatagttacatagcctcaaagtctctctctacaaattacttattaattacaaagagcaaaatagtacctttacatcagagaaacctgcct

SEQ ID NO: 136953 - DNA, 1307 bp, Homo sapiens
ttcttcatgaaaacacctttcaatataacaggtaagaaattgaagaaaaaaattttgtcttccttatcagttcatagaccacttaggtcagtcttaggctgcaatcatgaattgcttcattgtgtgtgaaggttgcacgaaggggttgtgctgaataattatttttgatagcatatttaacagattattttgttttggttatgtaacaggaacgtatttttgtggggaaaacaggagatggatagaaaccaccaactggtagaatttaggttgccttttaatgataaaggattagtgacattttaactggcctaatttctttggttgaagtcaaagcagtgatttgggttatccatgtgtataatgcatggttttttcttaatttgcagaccatgaagattatgacccacaaactgtgaggctgggaagtagatatagtcatgttcaagaagttcaagaacggcttaacttccttaggtttgttttatacagttagtgttgctctctttaagaaaaagataaggaatacagaatgaatagactgtatagcttggtctttgttgggtggccttttcccaagtccccaagtcatgtaagacatttccctgtatttgttactaaatactttaaaatgattcgctgagttttaactttgttgcaatattttaagagaacacattttaacctttagaattgacttcgttcttcatatctgtttatgctggaaataatgtttatttttaaagggcaaattcccatattttgacacaaccggaaggaggactatactgacttaatgatatcatagacactaaggaaacgggggcaaaaggctgctagaccagcacctcaaaagagtggttggagtcctctggtatcttgtttattctaacagtggctgacaggcaatctaaagtcatgtgttaataatatcatttctgattggcttgaggggaaaaggtttattaagataaaatgtagtctagggctggattttctctgcaatatttagcgtttggtgatcatacacttaacagatgtgcaaagtgcctttgttaaaaattttgatggtcaggcacggtggctcacacctgtaatcccaacacttggggaggccaaggcaagtggatggtttgagcccaggagttcaagaccagcctgggcagcatggcgaaatcccatctctaaaaaaaaatacaaaaatcagccaggcatggtggtgttcacctgtagtcccgggtactcgggaggctggggtgggaggatcacttcaacctcggaggcggaggttgcagtgagctgtgatt

SEQ ID NO: 136954 - DNA, 1331 bp, Homo sapiens
ccactgcactccagaccctgtctcaaaaaaaaaaaaaaaattttttttttaaatgagaggttccttttgaattcaaaaaaccacatgtagcaaaagagcttgtttagattacaagtgtgctaacagaaatgcccagattatcactgcttcttgaagtctattttatttatttatcttatttttttgagacggagtctcactctgtcgccaggctgaagtgcagtggtgagatctcagctcactgcaacctccacctcccaggtacaattctcctgcctcagcctcccaagtaactgggactacaggcatgcgccaccacgcccagctaatttttgtgtttttagaagagacggggtttcaccatgttggccaggatggtctctatctcttgacctcgtgatctgcccgcctcggtcccccaaagtgctggtattaaggtgtaagccaccgtgcctggccccatttattttaataacatattctgggtagttttgtcctgggctgtgttaattatggatttctatttattgaactctgtgcttatttatggagaaaattttaagtagctatataatgattttgaggaaaaacctctaccaaattttaagaaatttggcatttgtttaaagtgcattgtttttttttttcctgtgtgttttgtttttaaccacctggatagaaggacttgcctcctccccacattgagagttactgccatagtaagcagtcgttactgattggcatgtgttatatgtctcttaggtttactagaacagaaaagtggtttcaagcctttttgccattttaaagtttggaatcagaggaactattgtagtttctactctgttagtacctctgtatgtgagctaatagcaactaactcaaggaagaggaacctgactttaatgcctgctgtgtgttgggcctgtgccagacactttatatttactccgaagcaacacagtgcagcaggtgttactcccatctgatcagtaagaaacccaagattccaatggcttaaggtagcttgtttgaaatatcacagccagtatacgatggaattgcactactcaactaggtctcttttacttaagtctgtgctcttcctattagaccggtagtttttcaaacttacgtaggagctttagggcttctgagttaagttccttgaagatttctgaacaagcagtaggaagtttcccgatttttcctttctttttcctctcccaacaactggtgcagctctactttttaaaatatatatcagattccaaatgggattttcatttgaagaagggtctatgccatctttagaaaaaaacaaaaaaatg

SEQ ID NO: 136955 - DNA, 1500 bp, Homo sapiens
ccacacccggctaatttttatatttttagtcaagatggggttttgccatgttggccaggctggtcacaaactcctgacctcaggtgatccgcccacctcagcctcccaaagtgctggcattacaggcgtgagttactgtgcccagcctaagtcttttatttttaactcaagctactaaacatgcttctttccaaaagtctggtttcaaaaactaaaggttcatggaatgaatcttttattcctaattcagctagctgcatttcaggcacaaagtgggtgttcagtgtgtgcttgttgaattaattaatatctagtggggatttttttttagtaccagataaaagtagagaaataggttattttgaaagaatgaatatctttttatctatagttaaaatataatggtgataaatgtattttataggtaatacagattgcctttccggataaaaattacataaatctaattgccaattttcaatgttttttcaagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtaagtcaaaagtaggaactctgtaaatggtgtctgatgtactttttcatgtacgtaaggaattgtaattttgcatataaattgtgtattttactctgatgtttgtctcaggaatttggtgtagttaggaattgttcatttttattatgtcacctgtcagtgggctttttcttctctcttcctctccctcctcctgccactgatgttccttttgtcttagcttagtatctgtgtattccatagatgtgcactaaacatacaaatctttcattcctcccccgtggatattaatgttccttcccgagttttcattcagtgtcgatctgtttcctcctcttcaatgtttaacactaaaatagaggacagaagagaggacttgtgtttagtatagattatgagtatatgctttattggcactgtttaccttgtgatatttttaaatacctgggggaataaaatactatctttttaaggctaatctatttttatagtactactctattatgcctatctttaatctgacctgttatacagcagtttatattgtttggatgtctcacatattttcctgcaaaccatagataaagatgtttattgtggcatttgagtatttaaaagcttttaattaagtatgtggttttcaacattgttttaacagcagaaa

SEQ ID NO: 136956 - DNA, 1101 bp, Homo sapiens
tgatgatattgccagcagagctatagatctcctcaaagagatatacacgaaccttggtccaagactacaagtcaatcaggtgaggattgatgtgcattaaaacttccatatataattctttcggcccccatttctcttatacaaaagagaaaaaatattatctaaatgaatcttgccttgttagttgtcttgaagtgattgggttatttttaatataactatttattagatgttgaaatggcaaagaaagtctatgtgaattcattttgatgctaacacctaatcctgaagttcacttttgactaatttatgtttgttaacttatgtaatgctagcttccttttaataaacatacattttattattgtatggattctctacttaaatatgactgttgttaattgagtgctacaattaaatcagccattgccatctttaattggattaatatttggtttttacattttaaagcaattttaactgtgtttatttggcctgatatttgtaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgaggtttgtgaataactaatctattggtgctaattcttaattatttgatattttcctagccatttggtaaaaggagagcagaaatttttctcgtttgaaaattgttgtctttgcccattaaaaacattttcatttcatctaattttttttaataacctcccccactctcccatctggttttgttttggttttttgggtgaggcattcttaagttgttttctagttttctttttgtctttgacattattactcattaagtgttgcagtggcattttgcagttgaagtgtttttgtttatttgtttattttgagaaaaggtcttattctgtcacccaggctggaatgccgaggtgtaatcatggctcactgcgggctcaagcgacc

SEQ ID NO: 136957 - DNA, 2594 bp, Homo sapiens
agttttaccatgttggccaggctgatctcgaactactgacctcaagtgatccacccgcctcggcctcccaaagtgctgggattataggcatgaggcaccatgcctggccttattttcaagatactgaaagtaatacaggttgagtatccctaatccaagaaatccaaaatttgtctggtcccagacatttcatataagggattctcaagctgtattaagtatctttaattcacatcctcttgtttaataagaaaatacttagtgttaaatccccagcattattttcttggcaacaaaatttcagagtctgctgaatatgatgatgtctgtctttctttttccccccagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcggtatgtatgtatagttaacagatttttcaataaaatcaaaccagagactatcgtttaatcagtaaatactaattgagcatttgttatgtttgggactgtgttaggtgttagagttatagcattaaagtatagcatgtagtctttcggattttttggttggtatatcactaagttttgtgttttgtgtaagtatttttccttgtttttgatattaacatagtatataattttcagcttattacagccaaacttacacagataagttccaatatgccttcaagccctgatagctcttctgattcctccactggatctcctggaaaccatggtaatcattacagtgatggtcccaatccagaagtggaaagctgtttgcctggagtggtgagtagatacagttttgaactactgtatgtaaggcatcatgctagggtttttgagaataaagtatatagagtggttctttcttttcttgaggagcttacagtttaatgagacaaaaaaatacagttaaccaccaacttcagaatggatccctctaaaaggtaattgtaacacagttggaatttaaaacataatttccccataggtatagtattgttacttttacataaaattaaccaattagagcttaattataacactattggatgtataaatttagaggaaaacagtcatccctcgtatacgtggagaattggttccaggacctctgcatatacccaaaatgctgcagatgaccctgtgcaaccagatatacaaaaagttagccttccatatacttgggttttgcttgctggaaatactgaattttctgtccacatttgattgggaaaaaagtctgcatgtaaatggacctgtgcagttcaaacttgtgttgttcaagagtcagctgtatcactttctaaaatttataccacaaaacggatagttcttttagaactatatatgagctgggcatggtggctcacacctgtaattccagctactggggaggctgtgaggcaggaggattgcttgagcccaggagttctaggctgcagtgagctgcgattgtgccattatgctctagcctggtcaacagagtgagaccccatctctaaaaatataaataaatgaaaacaagaactatgtaggaaaatacctgtaatctttatcagattgtcagtaacatatagccaaagaaatatttttaagctctcctttcgcccctcccgacagaaattttaatggttacaatagtagcagccactccagtgtcaggaggatttggctctctataacaactggattaagaatttggtagtgggcatggcagccttttgttatgtccagagtctaaattgtatatatgagagaaatggtttaatagaacaggagaggagctatcacaaaaaaatgactggaagtgacttgatgatgtatttgatctgcactattaaggatttgtagggattaaaagatgggaaagtcagactatttcaaagagtagaaatttcataagtaaaagtatagggattaacacagagaaacttacttgggcttttataaaacgggagtaaataatttagaggtaattattttgtgtattttatattctagataatgtcactgcatcccagatacatctcttttctttggcaagttgcagacttaggtagcagcctaaatatgccaccccttagagatggagcaagagtacttatgaaacttatgccgccaggtaagaatttttaaatgatgatcaagtacttgctggacaataaaggagtatattagcaaattctgtttctaaatggaccgtgctttttggtatagactataacaagagttgacagatgacagcccacaagccacatcaagccccctgcttgtttttgtgcatcccaagagctatatttttaagtggctacaaaaaaaaaatctagaagaataatattttgtgatacatgaaaattatatgaagtttaaattttagtgtccatgatcaaaaccaggctcattt

SEQ ID NO: 136958 - DNA, 2468 bp, Homo sapiens
gtttcatcatgttggtcaggctggtctcgaacacctgacctcaggtgatctgcctgcctcagcttcccagagtgctgggattacaggcgtgagccactgcgcccagacctatttttcttttctttaaaagaagcttttacttaaaaaaaaaaaaaaaaattatcaaggtatttttttaatcatagggcagttaccttagatcatcaaaatactttccaaggttgattgactattaataaagttggaatatttggtagctaatgcttaattgtattttgggattatcttatttttcccccactgtgtcttttcaccgtaatttaaaattatgttttaatattatgacaaaaggacaaaagctctgcttgctttgaggtgaatgtacataggcacttaccctttttcgatgtttgctttttagggttcattttcttggatatcactacattcctttcagtgaagcaagccagttaatatatagtgtcagggggcaaacaataaagaggttagagggaagagtttataatttttttcttgttattttcagtcagaactacttccttttgaaatgtatttttttccatctccagtggctgagaggagagtatcttgatttgaggtccctgagtagcagatgctttgtattgagagtaactgattaaagagccctgttttttgtttttgtttttgtttattttttttttcttttttaatcattccaggtcttgtcatgtcttaggaagtttgagcctatagcccaactgagtggattgttattccatattagtatggtcttcaagatatcaaaagttaaatatgtatgaacacatgaattacattttcacactgtctctttttttcctccagatagcacaacgatagaaaaattaagagctatttgtttagaccatgccaaacttggagaaagcagccttagtccatctcttgactcacttttctttggtccttcagcctcacaagtgctatatctaacagaggttagtttttggggttttttgttgttgttgttttctttgtttttccttttaaatttattctgtgttctttaaatttgacctttcatatggtaaggtgaatgatttgggtaaaattgtaatgaagtagttttgaaatgaaatattaatttgaaataaataatagtgagatggtcaagagtttcttggcactgacaatagtacaaatagaagttattttttttttaaatcttttaatacagccctctccccctcttctctatttttccaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagactttttaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagatataattggtttatcttgttgcttgtttcccttcccaccttgggcttaaacccaagttctgagcttattctgactcggtttctgccttggtggcattcttgatccatgtcacaaaaaattctcaagacatgccagaatttgatacttatttatgagagatcaaactatgcatttaattctaagtaaagttttataaacatcataaatgattgttttactaagttactgatagaaggtaaaacttcagggataaagattttcttctttagaaatggcttagttttcaattgtggagatcagaatgttgatatttatggtaatatcacatataattgttttagctatgataatactgtggttatgtttaaaaggaagagccccctatatttttgaagtgattgctaagatacttccaggtgaaattacatgatatctaggatttgcttaaaaacaatcctggggtggagaagtgatggaaagcaagggaggatagtcagattaaacaatttggttcactggcgataattcctgaagctaagtaatatgtacatgggagttaattatactactttcgacactttgatgtgtgttacgaattttctgtaaaa

SEQ ID NO: 136959 - DNA, 1072 bp, Homo sapiens
aggcagtcagaattacctcgctaacaactacgtaatgaaattaatctgtcactgatttaacaacttgattatagcattaagtaaaaactagggtacctttcatacattagtcctcttactgctttttcagtattccttaatttttcttttttttttccaaagaaaaatgtggtaacaatggggaatacaagcagggtctgcccaaggcatgtacataaaagatgtacaatactttactgagtctctagaagggaaccagtctatttagtgtatcattatcccctgcaagttaagctgaggccagatttagagacacgagttgattgctctagaatggggatttgcagacacgtggcactacagtgcacaaggaagagaggaagcccactttgttggcagtgctttttgtgtaagttgccacaggttctataatgtgtatatgcaaggaagtcgttctgcaggagtgggtgatgaatgaagagcaattggttaggtctggttatgtacaaattatttactccaaataaaatggttaacttttttcagatcaaccaagttacccatgatcaagcagtggtgctacaaagtgcccttcagagcattcctaatccatcatccgagtgcatgcttagaaatgtgtcagttcgtcttgctcagcagatatctgatgaggttagttttatcaagacttctgtcacaattttaactttcctaggcccacttattttaatcactgtctcattctatagataatgtccccttaatatcagttttgtctactattaatattagtactttctgtttttaatcaactttatgtataataaacagcatccttttaaagtatacagatggggtgattttttttttttttgagacggagtctcactctgttgcccaggctggagtgctgtggtgctatctcggctcactgcaacctccacctcccaggttcaagtgattattctgcctcagcctccacagtagctgggattacaggtgccacacccacccccccatgcccggctatttttttatttttagtagagatggggtttcatgatgttggcca

SEQ ID NO: 136960 - DNA, 1138 bp, Homo sapiens
atattccacattttgtttatccatatacttggtgaaggacagttggatcattttccctttttggctgtgaataaagctgatgtaaacattgtgtacaagtgtttgtgtagacataaattttcatttttcttggataagaaactacgagtggaaaggttgtcatctttgtagtagtaaaatgtaatagtaaagagctagagaacttggggagcgtactttgttgtattgctgtttaaaggcaggaggtggggaataagccaggtgcagtggcagatgcctggacttccacctacttgggagcatgaggtaggaggatctcttgagcccaggagttcaaggctgtagtgagctatgatcacaccactgtactctagactgggtgacagagccagagggccctccgcccccacctttttttttttttttttttaagacaaaggcaacttgggaatttaaaaacaatggtactacacagtaattcctatttcctttacaaagtgaaacatttttgtttttctaaacataatttcactctcattctatcaacagttctatttactcgttatcttgcaggcttcaagatatatgcctgatatttgtgtaattagagctatacaaaaaattatctgggcatcaggatgtgggtcgttacagctagtatttagcccaaatgaagaaatcactaaaatttatgagaaggtaagaattatcacagaactatattccttgtaaacaaatgtttcttaattgtgcatgtggtttgatttttattagctttgctatttttaaaaattgaatcacttgcatcttaatggttgaaaattaattgatagctatgttgagaatatggtaaaattttactttgaaaatgaagtacttaagaatcgtgccatgtggctgctttttaaatgaaattgccttttgctgcttcttgtgggggtcagatataattgtctcatactgaatttgctttatcccattctcttttttcttttatcatctttctgtcctgcgtaaattttggtttgtcagttatggtatggcatttaagtatttttatttgattgtcttaaagcagtcaaaaataagagtgttagccaattagatatcattcctgaccttctattagattaagcaa

SEQ ID NO: 136961 - DNA, 1062 bp, Homo sapiens
gttactactttttgattaataaagtcagattagaattcattaggtacctccccaggcatattttaggttgtaagcctttgaaacccttcctgaatagttgtcagacaattgattttgaataaaatggcacaataggcaagcaacataatggaactagtcaaaagtacctaagtgctatgccacagtggttcctgagaaaggattggttgttggttcagaagtaaacaactcagaaggtctcaaaaagataggtagtgtgctcagtgtgctccttcagccctcctgaagacataggaaaataatggaattagactttattttctattatagtcatttccagactattccaaaggggcctcaagagttaacatgcagccatggagaggctgaggccaggtggtttaagtgagcagatgagttttaagcactaactagaagttgtgtgagatttttcttaaatacttctttgggtaatttgttcttgattgtaattttacagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaagtaagtatcttttttaattgtaagaaacttactttttgtaaatggagtgaattaatttaggctggcaaaatgtgtccccaaaattaaatatttattgtctctatggcatattggtattgaggaaaattttattatttaagagtgttttgcttaacctaaatgtttggttttagtctctgcaaatgccaatattaattgtcaaagcatgatttttttctaatcttagaatttagttttacctgggaggtatatagattagcctatttctaaaaatctagtttgcaagatttaaatcatataggacattagcctcctatcttagattcctagatgccaggttttttttaaagccaaacagaatttgatatgaaatttgtaagacagggtcattgtaag

SEQ ID NO: 136962 - DNA, 3048 bp, Homo sapiens
tagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcatttaatgaggcaaacctctgttttgtaagaatgcatcttgtatatctttaatgagttttttcatacatgtagtaacacaaggaaacaaagtttcatttttgtacattttatttctattcaaaatgggtttaatttgctatacacttgattaaaggagcaaacatttaaaataaaaattttgataagtactatattcagttctttcttaatatttacaaatttatttaacctgcgaaattaggtatgttagtgatagtaaatagtgttttgaaggaagatctttttattagaaaatctgagttttctgagatgtaatgagatcttaaattccaatgagtaattttaaaatgatttacttacaagagaactttttttttctaaaaatatatagcattgctaatatgtaatccctttttcaactttttaggaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactagtaagtatttttaatagaatgtgataattgatcatttcaatgtttcaaagttgttttcctgtttttctttcagaaaatatttccaacttacgtatttctttcagtaactagtttaacatttttagtgagtgaatgaacagttaagaccattataggccgggcacggtggctcaggcctgtaatcccagcactttgggaggccaaggtgggtggatcacctgaggtcaggagtttgagaccagcctgaccatggtgaaaccctgtctctacaaaaaatacaaaaattagctgggcattgtggtgcacacctgtaatcccagctactcaggaggctgagacaggagaattgcttgaacccaggaggtggaggttgcagtgagccgagatcgcgccactgcactccatcctg

SEQ ID NO: 136963 - DNA, 3179 bp, Homo sapiens
cttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaacatagtatagttctcactacctaccagaatttaaactgcagataatttttagaatggtttgtacatttctaaagcaacagttggctgggcatggtagctcacacctataatctcagcactttgggaagctgaggcaggtggatcacctgaggtcaggagttcaagaccagcctggccaacatagtgaaaccccatgtctactaaaaatacaaaaattagctgggtgtggtggcacatgcctgtagtcctagctactcggaaggctgaggcaggagaatcacttgaacccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttatacagtatctgccaatttcactgtgtgtgcttacttttaggttattctttgaatttcccttagatcatagctcttcttgattaggaaacaaactttccctactttaaatagtctcacgtagtcttgtggcaaaatttaggctgcctactgagtatccagtgcagtataaagcagtgaagaagttgagttgtagtggcgaatcagaattgacataactgtaagatagctctttaaagaagagcatatggcaagaagacttaagttgtggtcatgtttgtgcttaccatgtaatatttccttggttttacttttcctgtttatagtgatagtgggaactgaagagagaagccagagtatattctaattgtagtaaatggttcttttcattccctcccttcagttgccagaactgattttgctctgaagaagtagtttatcaattggagcttctgaaacatctacttgcctcaactcttccctagacctgctgtgccagatggtctagggattgggttctgagcactttcactttataaaaaaaagcttcataaaggacacttatacccatacctgattaaaaaccactgctctgggaaaaaaatgtaattcaaattccagttctggagcccatcatatacctgggatattgagttaaacacaagtagatataggtaattgtactggcaagaagtaaatgaggcatagaaaatataacacaatttcaaataaggtgtaccacttttactctcatggtatcctctgctccatgttgtctctgcaccccagtgtactgtgggagtttttgtggggttttttgggttttggtttttttggcttatgtttttgtttccatccctagagtataagtttctcatgggcagggactggttgttgtctatttctatatcagagttatcagatacaactcagagaatactgaaagatagttaaatgtaaaaacacattcttctttgtagctgccatatgattatgacctttaggaattctgtcttcatgttacatcttacaccactacttctgttgttttttaaaattgtggtaaaatacatataacatgaaacttaccatctgtttttaaatgtgcagttgtcctattaaatacatttacattgttgtacaccatcaccaccacccatctccaaaactcttcatattgcaaaactcaaactgtagtcattaagctactccccattctccctccccacagcctctggcaactactattctttttgtctctatgattgactactctacatacctcatataagtgattatataagtgaaatcatacagtgtttgcctttgcatagctggcttatttcattttaaagtctaagtaatattccattatatgtatataccacattttccttatccattcatttgtcgatggacatttgggttgcttccccatttgagctattgtgaataaggctgccatgaacatggatatacaaatagctgtttgaggtcctgctttcaatatttccaggcatatgctcaga

SEQ ID NO: 136964 - DNA, 2026 bp, Homo sapiens
gttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttgctcttgttgcccaggctggagtgcagtggtgtgatcttggctcactgcaacatccgcctcccagattcaagtgattctcctgcctcagcctcccaagtagctgggattacaggcacccaccaccacgcctagctgattttttgtatttttagtggagacggggttttaccatgttggcccagactggtctcgaactcctgacctcaggtgattcccatctcagcctcccaaagtgctgggattacaggcgtgagccactgtgcccggcccctacctatttctttctagattgttttgaagcaaatcttagttccatctgtaaatacttaagtatgtgtctgtagtgtctgtctcaaaacatgatcatgataccattatgtttttttaaaattgcttaatatcaaatatctctgtcagtgtttgaatttaccgagttatctcataactggtttttactgatattttttaaaaataagattcagttgaggtccatttaccacaaatggttggtaatgatcttgattattcatctgtttcttttttccctttacaattatgggggaatcggaggacaaatagtttagcatgtaaattttcccacagtctgaattttgttgatggaatccctgtggtcgtttattattttctgtttttcttggtcacctgcatcttctataaacaccttatgagatctagaggcttgatcagattgtggtattatttttctttttgtggaatggataggcaacgctacttcataggggataatgtttatctccatgaggagtgacattataatgtctgtcttcttatgatgttaacagcaattttttattattattattatatatatacaatttttttttttcccctgagatggagtctttgctctgtcgcccaggctag

SEQ ID NO: 136965 - DNA, 2143 bp, Homo sapiens
tgcaaacaggacgcttcaccccttcatacttcaacatatatcttataagagatcatatatcagaataaggcaattttcctacttatgtatgatacagttatatccaagtaatataataacgatttttaatctctaatattcatcagtatatattccgatttcccaaaagtggtctttataacttatctctctatcccaatctgatactcatgaaggaatcacaaggatttggctgttagctctttagttgccttttatgtaaaataatctccctaacttgtgacttgtatcgcactgaaatttttaaagaatccaggccagttgtcttgcagaatgtgttttttgatttgtgtgattgtttcctgatgattagctttatgttaaatgttgagggggtgggggcaataaaactacataattgatgttttgtgtttctcactgcactgtattgggaggcatgtgttatccacttaattattaagtgatattaattttgatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatttaagagtaactagatctgatctttttactatttataatccaaaatttaagcaaaatgaaagaaataaaatagtgattgtaacatccacataagagtgagatccaccacctcatcttaatagtatctttaattggattcaaaatgcatgcatgtgtcataccacctgaagcaaccatccttcctggagccgtactatccatcaattacaccactagttttgtggcagttctttgccgctagagtactagttttactatgaggctcactctcttaccccactacattctacagggaaagcacattctttttttcctactttttccatgtaattgaggaataaaatctcggttttatatactgttgtttgtggtcttgttgcttttttttcccctgaaaaatatagttgtacatattgttctgtgaatgttacatgttacatgttttatttcattcatttcttaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtaagtactaattacacattgaaagtatatgttgtaccatgtatatactaacagaaataaaatttttactagtacttacatacaaaagtggagtatatcactgattactaaatacctgaaacagaatgatttatatactttgcataccttactgctgtggggcttttttttgtttttgtcagttaacttttagttccttctactctgcctgatctcttagccattttattatattatactcttacagtctctttcttcctttcctttcctttcctttctcctttttcttttcctttctctttttttttctttctttcttttttgaaagagacaaggtttctctttgttgcctaggctggagttcagtggcatggtcgtaactcatagtaactttgaacttgtgggctcaagcaatcctgctgcctcagcctctcaaatagctgggactacaggcatgtgccaccacacctggctaatttgtaaatttttttag

SEQ ID NO: 136966 - DNA, 3916 bp, Homo sapiens
ttaaataagggactatcttaaacagtgaatatccctcagtacttttacacatagaaagcactctcagtctatccattggatgaattaatggttaataatgtattcctcacatcccttgttttgcatttatgcatgtgtctcaccagaaattggaaagtctctttggtagaaaatgaccataaactgggattctagctccttctcaggttgctaatcctgtactcatttgtgtgtgcaaacttttgctttactaaggcttccattacagaaaaggaagaatatataaaaatttagcttattcgtagtttatcattttcagaacttaataaattcatgctttggcttcagcatgaattactatctaaacagataacactagaagcagcatcgtatactacaaagagattaagctgtgagcccagacagattcaactttaaaataccatttcacctaataatcttgatcaagttaacttttttattgctaacattctatgacttacgggtttcgcattataaaaatggcaaatgtatgggtgcagcaaaccaacatggcacatgtatacatatgtaacaaacctgcacgttgtggacatgtaccctagaacttaaagtataatttaaaaaaaaaaggcaaatgtagtttacattaagtccataactaaaatgtttacaaaactaagggataaatcctttttttaaatcgtttttaggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggtacgggctgtccagttttgtttaattttgattacatttaatggatttagaagaaattggtttttttggttcatcctcacaagtcaccctatttttattttctcctactttggtatagtggtagcagagaagtagtcaatatgataactaatagaaggtttggcaaggaaggaaaaaaagtagtgccaaaggggctaggtaaataagataaaaataggtaaataagagtgaataattttaaaagtcataacgtgatagcacattctcttatataagttacacagacactttccatctctaccgagaaacaaattgccattgaacccctcaaagatacagagctgatagaggaaaacatttctcctgtcatgtccaggattacttgtcaagaccaaaacatttgctgaaaccattaattactttattgaaccacataagatttcttttagactagtcaagtggcccataagatttcttttatcacctatgttataaaaccatttattttggaaacttattagcagttctttgagagagatgattcacacgcattatagtaatgaataaggtgtatctttgggagctcccaaaccctttcaccctcaagtcacttgtgttgttttggccttatgcaccacttagagaagtcctgaagtttaaagattgagattgtgggctgtaaagccatactgcctgccacctgcagctcctgagacctgaggcaagttacttgacctctctgtgattactagttttcatcttttaaggttcagtagtacacacttgagaaggttgtaaggattcggtatgtttttacttgtgcggcacttagtatatattacctggcatctgaattacccaacaaatattagctactcttattgttattgtagttctttggtttgtgcataggaaaccaccttcgtgggaacaacagtaaacatcaaacaggtaataatggctagataacaatgacagaaaccagtcaacaatttaccatttgcatattattaatttcagcatttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccggtgagtatcaagagagtttagcttcttagtaataaagaataatttatagtaggcgtcaacatgtttaagttcataaaattaatgttttcactttaaatgagtctaatttgctgggtgtggtggttcacgcctgtaatcccagcactttgggaggccgaggtaggtggatcacctgaggtcaagagttcaataccagcctgaccaacatggtgaaaccccatctctactaaaaatataaaaattagccaggcatggtggcatgcacctgtagtcccagctactccctgtagtcccagctactccggaggctgaggcaggagaatcgcttgaacctgggaggtggaggttgcagtgacccaaattgatggccactgcactccagcctgggtgacagtgagtctccatctcaaaaaaataaaataaaaaaataaatgggtctaaattaaagtagcctgagaagggttcttaacaaatttaggacttctcaaaattaatggaaacacagacttgtttgaaaatggggttggaaaataaaaatgtgtttttatatctgcattttatttatagggcaagatcacctgttgcctgaagcagaagaaatcactatgatcagtattcaacttgctgctaggttcctctttactacaggatttcacacaaagaaagtagtccgtggctctgccagtgattggtacattgctttggattttcattcctattatactaatgtttggtttgcttctttaatagattgctttatgtttttctaaaccaagagaattttgtttgaagtttggaatatagaataaaaactctgggtcacaatagagaaatcatattaaaatagttacttagtctaaacatggccttttgttattcagaagctgacttctgcttctattaccttgtatcatatctttgacatccctgcaccaaagactacaagctgagactgggggacagtgactcacacctgtaatgccagcactttgggaagccagggtgggaggattgcttgagctcgggagttcaggaccagcctaggcaacatagtgagacccccatctcttcaaagaagattttaaaaattacccaagtatggtggcgcacacctgtaa

SEQ ID NO: 136967 - DNA, 1804 bp, Homo sapiens
ttacctagattgaattctgacaccgattaaaagggtaaaaaattaaaatggttttcttaagtttctaattgtgaaagtatagaggccattatgatacattgatttaataatttttacttactcatttcaggaatatgtcaagataagggggtggtattttgtcattgaatctaggaagagtttgttaatggatttttagaggacaagctttcacctgtttggtaactctgagagaatagaccaagtcatagtatttatctattgttttaatattagaagcaacctttgctggttctctccagcagtagaggaagatctttgtcttttttttttggttcaatgagactcatccttttactatagagaacaagttattgacttaatagtcataggtttttttgttttattttaggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggtaattgcacagctttctttctaaatgatgagatgtttacaaataaattgtgtttcctggaagtcgaagtcacaagcatatgtgcatccacttgatatgtttacctaacagaaacacacaatatgatgtcagtgagttccatttaatattactgcatggcaatgaatagtaattattggctctttaaaaatgtaagagaattttctctgttcggttacatgcagtagcttaattataagtttactgttaagtagattttttcctattttgaaggttttttaaatagtcttagatttttttaaaaaattacaagtgtaaaaaattataatgaaatccgcctctgatcttcattccctttcccaagaagcaaaatagtttagtttgtgtgatcagtccttccataaatgtatgcctgtatcagcatatgtgcatgtcctttttatgcaagtagaagtatacatataccttgttgctgtaaaacaggtaatgttttatcctttacaggcttatgacaacttaagcttgagtgatcacttactaagagcagtactaaatctcttgagaagggaagtttcagagcatgggcgtcatttacagcagtatttcaacctgtttgtaatgtatgccaatttaggtaagaatttaagtttttcagaattctgttttgatgtatcatattaaattgtgaagtcatttaggtcaagtgatgaaatataatctgatctgaagtagaaacaatttcccataaaacctgttgtgaattttatctgaacatggcactttcaccttttactttgtttatgcatgtgtctttgtggtagacacaggtcagaatctgtgttttgatttttttttttttttaatctcctaatgcagtggtgccaaatctggctgcttttggaaaatactggtttctaggcctcttctcacactgattgaatcagcatccccaaagctaatgtcagggaatccatgttttcaaaggggtccccaaatggttgtgatactcaccaaatttagatagcagacttggtctgtacataagtttttgtttaagtaaactacaattatggataatataaatactcgcttaaaatattaatttaggggccgggcacaatggcttatgcctgtactcccagcactttgggaggccaaggcaagag

SEQ ID NO: 136968 - DNA, 1293 bp, Homo sapiens
aaataaaacatttggccagacatagtggctcatgcctgtaatcctagcattttgggaggccgaggtgggtgggtcacttgaggtcaagagttcaagaccagcctggcaaacatggcaaaaccccgtctctacaaaaatacaaaaaaattagccaggcgtggtgacgtgcacctgtagtcccagctactcggaaggctgaggcaggagaatcacttgaacctgggaggtggcggttgcagtgagctgagatcgccccattgcactccagcctgggcgacagagcgagactccatcttaaaaaaaataaaaaaaaattataggctattttctatcgtgaaagttgtgtattattattgtgaagaagcttattagttttttattggtgacaaatctgtattctaggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggtaaaaggaaaataacatttgtatgtttataatttgatttgttattcctttcattaagttactcaccatgtcttacttgtttttaggttgcatattcctatacctatgaactgcggccctatttggatctgcttttgcaaatcttactgattgaggactcctggcaaactcacaggtggatactctttttgtgactggaaacaattaggcttgcccaggtgttagagttaactgaaattgacagtcaccacattttttttaacctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgcccgaggattattttatgattatattacatttgttttagaattagtcacttgaagcaacttagtcattagtcacatgaagtataatagtatatgtaaaaagtcttcaggtaagtacggtttccatttttcatggtacttatattctgtaaagtcaccacagacactgagttagcaaatactgaaccattactcc

SEQ ID NO: 136969 - DNA, 2138 bp, Homo sapiens
ctgaataatattttgttttatggatatatatacaccacattttatttactggcacataatctttttaacacaaaagaaacaaggcatgtttgtgcccctacaatcatgttttaagttagttagttcagggaaagacaggactagttggctttgtattattactctgttgtagtttgggagaaactgaaatgaaatcctgtgttattggcaaatcagccaaattgtactattgcctgtcaaaatgctttgcctgccatgtattctcattattagaattcaaatactgtacctccaaattatgtcactgaatcctaacttgccttcagagatgcagttttataaaaggtattgatgtgtagcaaattaccctcaactacagcagtcataaacttagttataacttttttaaagtttgcattactctcgagtgtcctgaattcacttcaggtaatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatcccagcactttgggaggccgaggcaggcggatcacgaggtcaggagattgagaccatcctggctaacacggtgaaaccccgtctctactaaaaatacaaaaaattagctgggcgtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaagacattattgagtggcacatagtaggcactcagtatatattagctattagattttagatgtttttattttatatctggttctctttcagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcaggtgaggatttttttcttataattttgtagaaatcttaatcagaattaaggattctgttttaaaagaagagaatcatgagaacttggggttgtcattttaagttaactttgaagtattccaaatcctcttatctatatggttttattttcttttgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagtaattctttattttataggccagtgtttatgtattaatgatattattaaaagattatgttgaagttttgggttttgaaaaatgtttattcggctgggcatggtggctcacgcctgtaatcccaacactttgggaggccgaggcaggcggatcacctgaggtcaggagttcaagaccagcctggccaacaaggtgaaatcccatctccactaaaaatagaaaaattagtcgggcgtggtggcaggcgcctgtaatctcagctacttgggaggctgaggctggagaatgacttgaacccaggaggcacagattgcagtgagcggagatcgtgccagtgggctccagcttgggtgacaagagtgaaactccatctcaaaaaaagaaaagaaaagaatgtttattctatgtcattttaagctaatgaagggagctttcttttggagaaatttctgtgaaattgcctgaaatgtagtagttctgagagaatgcaaatcaggttttttgttttgttttttttttttttgttttttccccaagtt

SEQ ID NO: 136970 - DNA, 1288 bp, Homo sapiens
aaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcaggtgagccgcaagaaccccaccgggctggctgctgcgtgaattcctcccctgacctaacctggctaatggcgcagcgctaaccggcacccttacttttcattttctgggtgccccgggctggcgggtgtgagtgccccggggctatagagggataggaatgttggttggggctgtcgcccgggcccggtctcggcccgctgtattgtccccgggacgagcacaatggcggcttttgtgtgtgcgtgcgcaggcgggcggagggggaggaagtgcgcgcgctctcgcggggacgcgcatgcgcgaatcccgactgattagtgacctgggggggtttgcgggagtgcgcagcgcggcgggacgcgactggaggcccttttggcttggagggcttcggccttcacggctggcgcagcctggattcccgtccggaggacctggcggcacccggtgtttgcgtgcctgcgagcaaggggtagaacgcggcccaggaatgtgggagggggcggccttcgctcggggtaatggcggcggcctcttttgtgtggtgctgggcggcgctgtggctcacctccgggagacggcgggtctcgggcgggcgaaggcctggaaaggaggatggaatgggtttcttgttttttcccgggttccttccgctggctttttcgcttcagcccaggttccgcagggtccgggggccctgcgccgcagccggggaggctgcgtt

SEQ ID NO: 136971 - DNA, 2020 bp, Homo sapiens
attgtgctataacaagtgcaaaaggaaagtttgtgttcctaccgtgctttaaagtattgatggtagcaagagaaagcgcagtggtgtttttgctcatagaaattctggaaattaggtgcctgaagtcttacactcattttttaaaagtatagcatctgcttccagttttcagtgactccattgatgatgcatgcggtttggccgtatcatactgagctttaaacacaagatttataaacatggtatgtagtgcatcttttgcaaacaggttggcagcggtactgtgtgacttggtcttttgtggcttttttgagaaaaatgaaacactttgcatgtatagttttttctcccaactacttgtgagtagttcctggttataaaacgttatgaaggtagcacataacccttttctagaatgaagaggcttttgagctaccagtgtaaggggataggtagaaatagagatgaaaggcactaagatgtcctactctttaagagcattgaacgccagttgtgccatttattcaaagtcatctttgaacttatgttaaaatggggtaaaaacaggtaactacttcaggccgggctcatgcttgtaatcccagtgctttgggaggccaaggcaggtggttcacctgacctgaggtcaggagaccagcctgggcaacatggcgaaaccccatctctactaaaagtacaaaaagtagcctagcgtggtggcgcacccctgtaatcccagctactcggggaggtggaggttgcagtgagccgagatcacatgactgaattccagcctggatgacagagggagactctgtctcaaaaaaaataaaaataaaaacaaacgaaacagtcaaactacttaagagttgtgcttaacatagtgttctgtaagtggtaggtatattgctatttttttgttgttcttaagagtactacccgactaaaaatacttgggcaatatttagggatgaagtatctaactaaaagaacggccacttcgaaatttgtcctgacatttttcaggtgtgcattttaggtttaaaatatcaagtattacggaaagttggcattggaaactttcataaccggcactaaaacgaatcctttatctatttgacattgaggaataattttgagattcagtgtaagctttagtttggtgattagggagcctgtgctatggaacatgttagtgaaaatttattttgaatgcatgaattaaatttggacagtttctactgaacagcacaagcatcttggtgtgccgccttctgtagtatatacaatagtaatattgcatttgcttagagcattgcagacttgaaaacattcttagtcacattctcattaagggttggtattagccctgtgaggtggactgggcaactacttgaatgcagtactagcaaatgctagagggcaggactagttttctcttaatgtagtatttgagcacatggggtgctaaccatctcactctcttctagtttgctggcctagacctgaactcttcagataatcagagtggaggaagtacagccagcagtaagtacaacatcttgtgggtttattgaatattagagcttaacatcttaagatttcattgggcttatgtaaaatttaagaaatttgcctttcaattttttactgcttaaagaattatgtagtctttgtgttatagaattatgtagtacttagtgatcaatctaaagcatcgttgccttttttttttttttttggttgagatggagctttgctcttgttgcccaggttggagtgcaatggtgtgatctcggctcaccgcagtctctgcctccgggttcaagcgattctcctgcctcagcctcccgaatagctgtgcctttctgataataaaacatcaatgactagctggctctcttgagtaaaagcagctaatcattggaaagaaccttattatatcaaattatctctagaagagtttttgtccattataaatcctgagcccagtttagaggtgatgggaatgtgtccctgt

SEQ ID NO: 136972 - DNA, 12071 bp, Homo sapiens
ctcccctttgcagcttttccttgtttatttattgtatgttttgcaacttactggcatagaaacaaaagattgtgagatatgttacatgagtaatcttaaattgttacagtaatacttaatgcttttgttgacagttttgatgacagttctcttaaatctagcaggcctttaaaaaaatcacattaaatgaccactggtggctaaatgtgctcaatttgtggatttcaactattaggttccaaatcagcttttttttatcaaactcctttcagagttctccttatgaagcagtaacccatttaaaattagattcttatttttcccccctctcagtgtccaggtaagtaatcagattggaaggctggagattttaatttcccagaaccattttttagtaacagaaatttaaatgggaaggttttttggcatttaattaattttatatatatatatatttttttagaagggcgctatattcctcctcatttaaggaaccgagaagctactaaaggtaggtcctcacaagtaacttcgtaggtctattttttgcctcctttagaagttagtaaagcctaaggaaaaccaggcatttgggggaggtctaaacatggtgttgtttttctatgcttctgtcagccttggttcaaatactagagcttaataattttggaagaactcatctaatgttacgcagtgggaaattcggcattcctatgtcaaactgttctgacgccaagggcatggttttgtacagtttcactagtgttgtgctgaatctgtttgtaatcattcacagcatggttttagtttggaagaggtgggtgccctactgtgtaaaccaagctgtataatgataacaacctggttatttctgtcttggcaaagttgctagaaatgaagatgggcttattgtagaacagttaacaagttacagcgttggaagtgattctctggtttcatctccttgccttgctgcttttgaaaggttttgtccaaaatgtattacaatatctggtgtcttttcccattgtaattgtaacgtagtgatagatgacagctagtatatgtttcatattatgagacagctgttcgggtgctttatattctgtaaaatagaccatccaaaatttggaggaaaagggaaagtcaggaaaaccaaagattaggagggaagatactgtataaagaaggcagataggaagagtggagagtccacaggggagcacatggtttgctgctgttcctccatctccatatgtagtctgtattaccttcactgtcctggcaatgcatggatataaaatctgtattatttctaccagaagatcactttggctttttttttttttttttttttttgagacggagccttgctctgctgcggaggctggagtgcagtagcgcgggctcactgcaacctccgcctcctgggttcaagtgattctcctgcctcagcctcccaagtagctgggatcacaggcatgtgccaccatgcccggctaatttttgtatatttagtagagacggggttttgccttgttgcctaggctggtctcgaactcctgacctcaagtgatccacccgcctcagcctcccaaagtgctgggattacaggcgtgagccaccatgcctggctggcattatattctttttaggggaggttactttggaatttgtctttatcatcatggatgttctcaatattcctagtatactagctagaattgaccctcgtgtatatggcagtatcatagaggttttagagctggtagagatctggcaatctaacttaactctttcttgctagcaaaggctgttggtcacctgactggcctaacggtaggaggtagaaggcagaaggaaagtaactgaattgagaagctgtttctgtttaataaggtgttgctgaagctagttaaaccctctacctgtctttaaaccctctacctgtctttgggttaatttacatgtttgtcatccccttacctggatatttatagctgtacccaggaaccttgtctatactgagaatatatagtgatgagggtttttctttttcccaggtattcctgattgtcatcaagcttatagtagatgaaccactaaaataatactacaatttgacattagtgttcttgtactttatactattgaaactgaaaaatactgtattaaaccaagtaatctgacagtctatgaatgttctaaatgaataccacctccaagaaacatggaaacaatggtaactgtttttcctagtaaactcattcacacctataaaatgaatggaaattaaattgttatggtcacacaacgtcataatgcgttacaggcaaagctgttgaccacttagaggtagtattcattgagaaacattcttagactgtcagattgcttgatttagtgtaaagtaatttttttttttttgagacaagggtgtttcactcttgtttcccgtgctggagtgcagtggcgcaatcttggctcactgcaacctcagcctcccgggttcaagtgattctcctgcctcagcctcctgagtagctgggattacagacgtgggccaccacgcctggctaatattgtatatgtagtagagacggggtttctccatgttggtcaggctagtctcgaactcctgacctcaggtgacctgcccgccttggcctcccaaagtgctgggattacaggcgtgagccaccatgcctggccagtggacagtattttctagtggggagaattaaagaaaaactttgtccgggtgtaaaccagctttaaatcttggttctcttacagtgccatggtagggatagtcagtggaggctttcaaattcagaaagattgataataccttaacatggttcctatttctaattaataataaaatgtatttgtgcttttttaatcaaaggtttctacgataaagacagttcagggtggagttctagcaaagataaggatgcgtatagcagttttggatctcgtagtgattcaagagggaagtctagcttcttcagtgatcgtggaagtggatcaaggggaaggtaagtgatttcttaatcaccttacgtgtatgtataataacagtttaataagtcgttatcctgaccacctgtttggatgttaagcattatgtctgtttggtcattgtattttcttagccgtaagaggcttttactaaattgaacctgttacttagaaattagatgaaaataggaatatgctcattggcataatgaaatgagttattctatttctcgagttttatatgttctacttaaaagagtaagttcatctagtgaatggcctaatttggttgggatttttgtggactctataacaatttctaaacaccttgtatttttgattacacaagtgtggtgaactgaccccacgtgcctaatagctgtggttagtcctgtgtcctgatttttcgcaaacaggcctaaaactcttaaaaacatcttagttcaggtaaggattattttctaccttttatccaaagtctgtcacacaggtgaattgtcctttaagtgacatcctagtataactaggacgattgatatttggtgtgctattttcttgttttccctaccattaaatatatttggatgagcactttaaatgaaggttgtgagctgtgtgccgatttcaaataaaatccttattcttaattttggcatctgtgaggccttttaggctatacaactttatagaaatgtaaagattactgattttagaaaacgaggttatgtaaatgatgctggttagagagccttatttgtcaagtaactcagaattggattgttgacatccttatggttagccataacttaagtctccagatacagttctagagtagggataagaatctgataatggttaaatgatatgattctgattaattgcttgtgctgttcaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacagtaagtttttgaagtgtatgttacttgtgatgaagccttactagctagtataacaaatgaacttatccattttttgatttgagggaactcttttctggaggcaacactgggattaattttgagaaatacgatgacattccagttgaggcaacaggcaacaactgtcctccacatattgaaagtgtgagtatttttgcttgactttttaagacacagagaggttaaatgttttcatgttacattagaatgtgagatgggcttcataaagtcatgtagaccagaggcttcatagatttgtggaaaaggagaagttgagttcagtgtcaccattatgaataatttattacctaaaatagaaaatgggtcaaacataggaacaacccaaagtcttctccaatgtgcagtaagcctgggggttggtttttctcaaagtataatgtgataattttacttaaactataaactgagttaccaatcagctgttggttggttgtttccattattagtataaaacagaaatagctctagatagcattcctaaccccattgaatttcttaacagttcagtgatgttgagatgggagaaattatcatgggaaacattgagcttactcgttatactcgcccaactccagtgcaaaagcatgctattcctattatcaaagagaaaagagacttgatggcttgtgcccaaacaggtaagctcaactcataagagtaaaacatcatatttcttctgtaaaggactagacaataaaatattttattttttatgggtcatgcagttttgcagctgctctgcgctgctattggactgtgaaagaagccatagatgatacataaattattggttacggctgtattccgtaagagctttatttataaaaataacaggctttatttacaaaatagtctcagtttgctgactcctcttagaggtggagcagagaagccactttttggaaaacttaagcataaactaaaagtactaattattagtaatagggtagttaaaaaacactgtcatctaccaatgtctgtttaaaagtaatgagcaggatttgtttgtttgtttttgaacagggtctggaaaaactgcagcatttctgttgcccatcttgagtcagatttattcagatggtccaggcgaggctttgagggccatgaaggtagatgtttctttataaaatgggaaattgtagaactttgtaggtggccattgagagggctttctaaatgatgctaagacttaagtagaatgaaaaccagttttcaagtgtaatctgtaatctataaattacaaaagggaattatgttgtgatgaacttttcaaacagggtaggtagagttaacttaaaaattaacttatttcttaggaaaatggaaggtatgggcgccgcaaacaatacccaatctccttggtattagcaccaacgagagagttggcagtacagatctacgaggaagccagaaaagtaagtatgagttccagtgattattagctttttcattgattctaattaaatgttttatgaacatgtaaaaattttgaccttgaagttcataacattttttttgcttatagttttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaagtatgttttattttgtttttgtttttttgttttgttttgttttgttcttttgtttttggcagagttgcgctcttgttgcccaggctggagtgccatggcgcgatctcggctcaccacaacctctgcctcccgggttcaagcgattctcctgcctcagcctcccaggtagctgggattacaggcatgtgccaccacgctgggctaatttttgtatttttagtagaggcggggtttctccatgttggtcaggctggtctcgaactcctgacctcaggtgatccgcctgccttggcctcccaaagtgctgggattacaggtgtgagccatcgcacccggccaagtatgttaatttttaaatgtatgggatgcagtattaaagttactgcccattagttttgtggtgatgttaacattgtctaaatgttaaggctgagaagtgatgtatttcagacatctaactttcacaaaaagcttgttcatggtaattttaatgttgaaaaatcagtaacatcttggttgagacttacaacaatgatcagctcgtgggacagtcaactaggatgggctaatttgactgtgtaatcttgaatgacttatgtagtggcaagaatcctgtgctgtgtctgtaaaattatgcagtgtgaggcaccatcttaatgaatatataattgtaataacctatacaattgtatttgtaattatactaacagccatactaaaaccatgttgatttctcctcaaattctaaactcaggcttgttttttttcatgacatgacagatacttggtgttagatgaagctgatcggatgttggatatggggtttgagcctcagattcgtagaatagtcgaacaagatactatgcctccaaagggtgtccgccacactatgatgtttagtgctacttttcctaaggaaatacaggtactgtttgatgttgcaaattttatttatttagaaatttgtttatctcaggtaataataaaaattttttttctttcagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggtaacattatgaattttttattttattagacatgggggtttctctttgttgcccaggctggagtgcaggggttattcacaggtgtgatctcattactgatcagcatgggagtatttgacctgctctgtttctgacctgggcctgttcacccctccttaggcaacctggtgctcccttgcttccgggaggttaccatgttgatgccaaacttagtgtggacacctgataggcatagtacactacagcccagaactcctagacttagacaatcctcctgcctcagtctccagagtagctgggactacaggcactcaccactgcacccagctaaaattatgaataatttaattgctctggtaataacccatttgggctgggtgcagtggtacagtgcatgtagtcccagctacttggcaggctgaggctgtagtatgccatgattgcacctgcgaatggccagtgcactctcagcctgggcaatttagtgagacccccatctcttaaatgtatttggattacctttattacttttcctcctcaattcaaaacatgctgtgttgaaagcccgtttttaagaagatatatatgtattttaattgacacattaaaattgtgcatacataagtgcaaagagaactaagccatgttagtgacaaaaacctataatttttcaacgacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtatgtataaacatctttcttttattcaaattgagcatgttcaagtatttgttttcttttaagtgggccatatctcataaaagttattttccaggtagcagcaagaggactggacatttcaaatgtgaaacatgttatcaattttgacttgccaagtgatattgaagaatatgtacatcgtattggtcgtacgggacgtgtaggaaaccttggtaagtatttgattacttgatggtttcattgttttttgctgtgatgtgtgcaggaaagaacttgctaggatctaaaatacatttttaacaatgaaagtgacaaagattttgctcaaagcacttgtttaaatattacgtggtaatattttaaatatttctacgtaggaaagtaagaatagtagcaagttactttatggaagacctttgtttatatacttttttgggaactcttttaggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagaggtgaggtataaatagtatataatgaggggaatgggtgttcacttacagttcatagtgtttcctctgcatgcataacgtccaaggttaactgtacagtatttaaaaagcttaatcatcttaggcttcctagattctttggtaaggggttgtattagaatgggtgacactctgttggggaaaatatggctggatggggaattgtttgaatggaaaaattagaaattggtcattaggaaagagttaggttactttagtggaatttcatcttcatgtgaaccaacataatttttttcttatagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtagtgttaatctgtaacttcatagctttgggaagggtttttttccttttagtcatctttttcaaagcctaattaaacaatttaagttcagcactatagaaacttgatggcaaattacgtaagggaaggattgtatttaatgatggataacttcattaatttctctctctttttaaatctctcattaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaattgtaaaatgttattttttgcttgtcatccagtgctattttttgagatgcctcttggatacagaatgactcataccataagtatttgcaatgaaagatgaagatagtattagtttgaaatacagtgaaacaggatttttgtaatagacggaaatctaaaaggcccttactgataatacagcatgtattagaaattggcttatactttgaacaatttgacatgggtgggagtctctttgttctttgaagtatctattatgaaggatggttgaacagtggaagaatgagcaggataaaagtcaagtgtgtcagtagtccaacaagtgatggtaagtatatacttagggaaggaatcaagactatttgggcc

SEQ ID NO: 136973 - DNA, 1028 bp, Homo sapiens
ctggtctcaaactcctgacattaggtgacccacccaccttggctccccaaagtgctgggattacaggcattagccactgtgcctggccctggctagttatttttaaactccagttattttccagagctatctcccaaccatcaccattacggacaatgccctggagtctgagggttggcagtgccaggtgagggatgctagtgtctgtgagaaactgcccttggggagggagtggccaccaaccagcccaactgggtgggcagggctcctgggagaaacaggcagatgctgcacgggaatgaggcctgtgtgggcctcatgctgaagcttcaggggcggctcggtgtgagtgcattcagggttcgattctcaccacccccagtccctgcctgggcctgggtgaggtttgagggctgacccgaggcaagcccagagcaaagacaaggtgcacattgggctttcctgaggccttctccctccagttccaagccctttctcaaactgactgtttccccaggacatggccctgggggcgaggccagaatcccttgtggcctcttttctctctctctctcttttttttttgagatggagtttcgctcttgttgcccaggctggagtgcaatggcgtgatctcggctcaccgcatcctccgcctcccaggttcaagcaattctcctgcctcagcctccccagtagctgggattacaggcatttgccaccatgcccggctacttttgtatttttagtagagacagggtttctccatgttggtcaggctggtcttgaactcccgacctcaggtgatctgcccgccctggcctcccgaagtgctggaattacaggcgtgagccaccatgcccggccgttttttttttttgagacggagtctcactctgttgcccgggctggagtgtagtggcgaggtctcggctcactgcaacctccacctcccaagttcaagcaattctgcctcagcctcccgagtagctgggattacaggcgcccgccactacgcccagctaatt

SEQ ID NO: 136974 - DNA, 1090 bp, Homo sapiens
atatttatgagggatataatagcatgctctttgtctttgagaaaattcttttataagagattcaataaataagcaataaaaaaaattggagcaaggcacgtggaacactgtgataaataggacatgacttcctacctcgaagaggttctaaagaacagaggttgatatttatataattactaacagtcaacttcttgccattcctcctaccttgaaaaaaaaatgaaacttgattgactcattggggcacaatgtttgcttccaacagccagtatcattttaaacgtgcaccaaaagctctaccgttcctcacagaaagcagaccgtattcatagcctgcacacttcaaaacaggaactgtccctgctacagaaacccgaaatatatccagacttcttgtgacaagttggagagctcagcggtgacatcatttgctaacaatagatgcacttaaaattaatgaccatctccacatcccctggcactttaatttaaaacacactctagcaagcacagagaatatttctctgactgcgagtcacaagcaatacggacaatatgttcccgagaagcaggcagggatagtgctctacctccttggccagaaagaaaatgactaagtgagcctcacaaaacaacaccttggagaaatcagaagtggctcgcagcagggaaatttggggcaagagaaattctcctctggacacacagggctcctggaagtgccccacttctcagatgcataagtgcaaatacctccacctcctccccccatgttaacccctggggtcttcccgctgttcacagcataatatctgaaacccttaacttcttttacagggtctttcacatgtgacttcctctacactgagtcttcaaagagagtcaggggttgtgtgtttgtgttttttgtgtgtgtttcttttgagacagggtctcgctctgttgcccaggctggagtgcagtggcatgatctcagctcactgcaacctctgcctcccgggttcaagtgattctcgtgcctcagtctccagagtagctgggatgcgccaccaccacacctggttaatttttgtatgtttagtagtga

SEQ ID NO: 136975 - DNA, 1108 bp, Homo sapiens
atcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctt

SEQ ID NO: 136976 - DNA, 1885 bp, Homo sapiens
tggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgt

SEQ ID NO: 136977 - DNA, 1066 bp, Homo sapiens
gtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctct

SEQ ID NO: 136978 - DNA, 1205 bp, Homo sapiens
catcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggt

SEQ ID NO: 136979 - DNA, 1039 bp, Homo sapiens
aggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagct

SEQ ID NO: 136980 - DNA, 1069 bp, Homo sapiens
gagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcat

SEQ ID NO: 136981 - DNA, 1048 bp, Homo sapiens
aattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctg

SEQ ID NO: 136982 - DNA, 1061 bp, Homo sapiens
aaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatat

SEQ ID NO: 136983 - DNA, 1478 bp, Homo sapiens
ggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttgga

SEQ ID NO: 136984 - DNA, 1155 bp, Homo sapiens
aatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaa

SEQ ID NO: 136985 - DNA, 1048 bp, Homo sapiens
tcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactcca

SEQ ID NO: 136986 - DNA, 1293 bp, Homo sapiens
cctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctacttta

SEQ ID NO: 136987 - DNA, 1049 bp, Homo sapiens
accatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgct

SEQ ID NO: 136988 - DNA, 1072 bp, Homo sapiens
tgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaag

SEQ ID NO: 136989 - DNA, 1044 bp, Homo sapiens
taacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaa

SEQ ID NO: 136990 - DNA, 1043 bp, Homo sapiens
tgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagca

SEQ ID NO: 136991 - DNA, 1067 bp, Homo sapiens
tctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaa

SEQ ID NO: 136992 - DNA, 1015 bp, Homo sapiens
gaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggtttt

SEQ ID NO: 136993 - DNA, 1030 bp, Homo sapiens
atatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgc

SEQ ID NO: 136994 - DNA, 1058 bp, Homo sapiens
agattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgca

SEQ ID NO: 136995 - DNA, 1798 bp, Homo sapiens
cagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtga

SEQ ID NO: 136996 - DNA, 1134 bp, Homo sapiens
tcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattct

SEQ ID NO: 136997 - DNA, 1045 bp, Homo sapiens
tagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagataga

SEQ ID NO: 136998 - DNA, 1106 bp, Homo sapiens
ctttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccag

SEQ ID NO: 136999 - DNA, 1040 bp, Homo sapiens
acttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagt

SEQ ID NO: 137000 - DNA, 1040 bp, Homo sapiens
ggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctc

SEQ ID NO: 137001 - DNA, 1060 bp, Homo sapiens
ctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaa

SEQ ID NO: 137002 - DNA, 1042 bp, Homo sapiens
ttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaa

SEQ ID NO: 137003 - DNA, 1429 bp, Homo sapiens
gggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattg

SEQ ID NO: 137004 - DNA, 1005 bp, Homo sapiens
ttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaa

SEQ ID NO: 137005 - DNA, 1050 bp, Homo sapiens
gggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatac

SEQ ID NO: 137006 - DNA, 1019 bp, Homo sapiens
agattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaatt

SEQ ID NO: 137007 - DNA, 1063 bp, Homo sapiens
tctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaa

SEQ ID NO: 137008 - DNA, 1270 bp, Homo sapiens
ggaggagaaagaggagggagcgtctctgccgccgcctcctggtccccagcgccgatccgccgccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccggg

SEQ ID NO: 137009 - DNA, 1034 bp, Homo sapiens
ccttccttctgaaagggcttctgggtgccatatcaaagtgtacaccacctgattctttgagtgtcattgtttgagttactcatatacgatagacttatgggtttgttaaaacattgtcttgaccaattaaataccaggtaaaagagattctgcagtttgacttcttatggcaacagaactcaagtggtctatttattgcctgtgaaatgatgtcatccttctactatggaagagttctgagaacatacgtgtttgcataagtgtgtgtgtttgtgcgtatgtatatgtgtcctccaatacaaaataaaggcacttttctctttatctctcttcctgtaaaccatatctccactttcccagccttgctttatctgtctcttctattcagtgtttttaatactacattttctcgtaacagaagggaatgtgagccaaagccacagggaattgaccttcttgtgttgttttctacagatgctaaggattagctaaaacaggcacttttgaggggaaggattacccaaaagacacagtaggttctagggcaaagaggtcagtattctggcagaggtggtagtcatagcagctggtatcaaatggcaatgatggcttgaggacagtggggtaaacactggtcactaggcttctgtttgggaatcatgagggagaggcctgctttgtacctgtccacagtatttcactattcccagtgtcatctggggctgtggattaaacatggagctggtgaaagcttataccttgcttcaccttcatattaacttgctccatctgggacttaagtttttcaagctattgaaaagcatttctctcaccaggactgcttgttggcaagggcctgaggaggaaggcaagacactgttattgttcctaccactgtttcagtcttgatggcagtgtaggtagctattctttggtggcatttatggtaacatttaataacatttatggtaaagtaaaacaaagaaaatcccagagaccttatctgtaattaatgggaaatggtggcagtaagt

SEQ ID NO: 137010 - DNA, 2399 bp, Homo sapiens
agcctcatcatgattgatatattgtcgcctatgttgccatcattggtaaaatgtttgaaaattaggaattttgttgcctttcatccctggctagaataccacactgacctatcctccccctactaggtgttaataatttctgagttatccctgcaggatctgattcagaaagagaaagctgatgggagggagtaagtagagtggccccacagtagccatttttatatataaatctttcgaggagactctgaacatgctacaaattaatgttgggtagagatagctttatctgaacccaacattgtttatcctgaacaggccaagagaagagattggcatgaactgttgctttgccagttccagccagtaccagcaaaaacatacatgtatgttggagcatcagaggaaagcagctcctggtggagagtaagaaaaaggagtatttcagcttgtttctctttatttatttatgtatttatttattcattcaaaaaacacttgttgagtacctgcaatgaagtggactgctgtttcccaaaatctggtcccactaggcaagcctcctaaaagcaatatggttgtagatcactggaaaataaatatgatgacaatgtgttatatacattgactaggggttctgggtcctctcccatctccataccatctgtattctgcaattcagagttctttctgggattttattcttagtctttttcttgttcagtctccagaattccttaaggagcgcggtttttttatttttcctctgcctgattacctgctcttcctccctttctatactttatgctccatacttggtcattagcagaggtgaaattaccatgtagctgataaactttatgctttatggccttataactgtaggttgcttctggttctcattctaaataaataaccagtttcatactcagtcctgtatttgcaattttgctttcttatttcttagagaggatacccaagttatatataagttgtaggtcccacaaaacctgaatctgtccatagtcactcttaattattaatttatttccatttgggggaagtagagggcatttcttgcacagtagttcacacctctattccagaggccagcttcagtgacactggaaaaagcacttgacttcctctaatgccatctccatcagtcagatctgagtgattttaatactcaaactgaccagaaacattgctttctatctgtggtaccttcccagatggttcacagctaaaatgaaagtagttgcaagtgtggctcgtgttagatcctggacataaactgagtgtttcatgagcgggtgagaagcatcacttcccaagcattcttgtgaattcagaaacataccatttttgtgtgtgcttggcagtatcccatgaattacttaatagtccctgtggcagttttatatgcctttggatgttctttataacttttattaggacttgtacactttgataggttacccacacattcataatacatcaccaatccatagcatcagcagtgttatttctattatatagcacccagaagagtacatattctaagtgacattactcaaaattgatccatattagcaacattttttaaataactctctacacagagaatagcagcatctggatgtatctccttttttgtcattataaaacataaaatagactatgtcttacaaccacaaactctttttatctgcctaaccaccaattaaataattatatatagtatgttaatagttgagaggggaaataaccctgctgatttgttggtctagtggtatctttaaaatgctctggtccttaaccatcattcatcatctatcacccattcctttttgaaactcctttcatgttttcagcgatgctattggatcctgaatttttatcccatactgattgctgcttttccatccctttcattgtgctcatattcttgcaaacatctggttttgaaaggtttcactgttcatcactttggggctcttggtactctctccctctctttctcattctaggacttcagctgtcccttatctatagaaaactctcaagtctctgatttgaatcctcttccttccctgaactcctgtcccatagcttatctgctcctgggtatttcacgattgaacacttcaggttcaacatgtaccatagctactgtgctagccaatccagcttcttttcctcagttccttgactctgttcttagcaccaccatcccttctataatttttgacataatcttttcttttatcttctgcacccttttagcagatccttctcactcttctttggggctatctctcttctcctttctctatgatgacctccctccccccatcaccaggacagactcttttttaaaagtattttgtataaat

SEQ ID NO: 137011 - DNA, 3055 bp, Homo sapiens
atgattgagtccacaacataccacaatttccctttttgctgaaatatatcacctgtaaaaattattctgctaggaccattttaggcattttaacccagaacttggcagcatgtactgtgtggttttgcagtgattaagaaaagcttccatttaagaaatgccacttatttttggtgtcttagttatttaaatactctgaggttcaatgtgggctgagcattaattttttgctgtttaggacacttctctgcccctaatttatattttatttttctaaaaaataaactagggtgtttttacttcataaactttttaaatactaaacaaagaatacaagaattacatttatttgtgttctgattttttttttttgaaatcttcatggttgaaggagcttttggatttatctggcattaaatgggaaattttagcatttagtcaatactaattgatttgaattgttacataatcctcagctattgtgaaaaatgtatttaacaatagatctaggtatagcataattgcatacattacagagaccaataatggagaaaaagaaacatggaacaccattattggtgaatattgggtcacaatctttgtgcagttatggcatagaaatattttaacctatgaaaaatcttgcagtatttgcattcaagtgtactcagaaagactaaggttgtattctagttttatattacatatagggtgcccagccctgtgatttagaaagtgtagacacccgataaatagttgttaaggaatatacttgtatgtaggagatgtatagatttcataatgatagggttttttttttcattgtaattagaacttcaaaaattgaatcaaaacattttctaaatgttgtgagcatttgagacaaattgattgttgggactgtttctcctcctttatcatgacaaatattttatatttttaccagcaatttgtattttccttcaaacaatctatttcttgttatgttgccatctgtcattgtgtattagggaaatttaaagtctttgaactatggttttgtcatccaagaagttggattaagttatatgtgatatatcttctggtatggatttttagtaattagtcaatttcatgaagatccgtctctttagctttctttcttggaccctcctcaacgtttttttcttctatgctttattctgggaagagtttgcattatctgtcatactgacattcttcacaaacttgaatcagggcctgggtctctccacaggtgctcattcacactttccccatggcttctctgagactttgtttaaaacccttttctagttgttgctaggcaaaagtaaacaaagcacactcaataacaatatttaattgattgactaagagtgttaagaacataaaaaacagatgataagatttaagagttgaagtaattatatattaaccatgtccaagggttatagaatggtggcctgtaagagcccaaagggactgaaacagaggctcagaggggtccagggaattaccaaatgccacaaaattcttagctgtttaacttgtccttggatgcgtaaaatactgacttccaggacagtgctctttctgtacctcacctcactggacctgctttgtcagctcatccatagatctgcagtaaaccttattattgctttactttgaacgttgatgctctaaagcatagtgactactgcttaacagtaatttatatattataagatatcacaaggaatgttattgctttctgaacatttaaatttaaaaatatgggacaccctattaaataaaatgactttcatatgacaaatctatttccttgttggaaaggccattcctggtgcatttaggatatgtagagattgttgggatagtttagatcagtgattcttgaccttttggaccaaatgtctcttggaaaatctgatgaaagctattggacgtttcaccaaaaaatgcgtatttttacgcatagatgtttttctcctctgcaccaggccaatgttctggaaacctcttctgcgtcactgtcctaatagtgtaattatttttagctgatactgagacttcacgaaagtggtgaaaaatatttcagaggattcattatatcattagacagttactagtaatgaatttttaaatagaccatgatgaagagtcaaaacattcaggctggacacgaaggcacctacatttgctatattagctctatgataactagagaagtgaaattgacatgttttgaaaagaaagaatttgggagaaaacattggtgaaggaaatggaaggctgtggtggttgagatttcttttagtagttttcaaagattgtttatttaaagtatcattagcccatcgtctattcagtgacttgtgtgaggcatagaatctgtgtaacctctgtgtcacaggggttacagagatgagcctgaaatgctcttcaaagttggttcagaggtccaatgtcagcacagaggagggaggagttaattccacctggaggaagtgacaaggaaaggatttcatggaggaagtcatactcgacagaagtgtcatagattttggataaattctgaaatgtaatgaagatgacctttaaggtgaccgtttccagattaaatgagttagcttggagctgtggcctaagttgaagaccattttcttgcttgtatgtatctgttcattcattcagtaaatatttgtcaattgtgcatcactgtatgccttgagtaaaatttgtggggtttgctctcgcttctctgctttgggcatattgcctcaaaaataaaatgcctcttcgaaaatctgatgaaatctgattgcctcaaaaatgaggcaatatgagttgatatttgactatactttttattgcccttggagtgttcagtccaagagtccaaatgtgcagttatgtaagaattcttttggccagagaccacttcactgaataatagagaattaacaatgtatcatgcagtgtactctgtgcaattcctaggtgatgatgcatatcaaagttgaagaaagatgtcactttcgggaataaagag

SEQ ID NO: 137012 - DNA, 1017 bp, Homo sapiens
gcaagctgttcagatgcgtcttccattagttcagaacttgcccgtttttcctaatgtgattcatccatgattcttcagagtcaaattaataaagttgaaatgcctgcagggctgccacagggttggtgtatgtttccaatattgttgcatgtttgtggcctcttcaaaggctgagtagtgagatctaaatcaagaccccaaagactgaggtgcaacacagtagaatacagtgttaccgcttctagtgtcttcatgctgaatttgaggcacttcatttagaacgttcttactttgtaaaggaacattctgcaaaatgcctcactctttttactgcttcatttaggattatttgctttaaagatagtgtcagcattctaaagacatcatgtttggaaactcccaggagtccccttgctgtctttgttaaagcccagaaatttattggagtactaattccagttttgttcattatatcttaaaatagttgttgtagattagaaaaggtttgaaggacagcactgatggttactaaaagagagaataaacattatatgagggcacattaaagaagtcacagaagcacttcatttctggtattatggcagaatggaaaccctaactcctcattgaaataagtaaaatgctgaatacaatatgctgtgctcatctgacatggaagttagaaatttgtagatctcctggatgttgcatagacatctcaaacgtaacacatccaacactagacttctgatcttccttaaggccgctgttccagctgcccatgttagaagatggcaacttcgaaaaaactcagagtcatgctcaacactaccagaccctcatttgttttgtcaggaaattccgttggccctgccttcaaaacatatccagaattcaacgcttcccaccacttccactgctatcccctggtgggagccaccattatatctctaggccagattactagagtaggctcctgattttcctgcttttactcctgccgcctacattctgttc

SEQ ID NO: 137013 - DNA, 1057 bp, Homo sapiens
atgttttcaagtgcaatgagtggcattcaacaaaaaataatcaggcaaacaaggaaaaaatgcatgacaacatgcttgagaattggtatacacaacaaaatagacacagaccctttatttattaaaaaaaaaaaaaccacggaagggttgcagctcaccaatattcaattattgattaaatcattggaactttccaattaataaaaacagctgaaaagcatggagaactgtatttatgagggaggaagtaaacaattttagtttatgatagagggtttgcatatttgtaaataatttagtgatatgtgaatctttttataccttcttgtattcttttcctatgacgcattctttcctggaagtgttttaaaatagcatctagagccatcaatgtggactgatttaagatttcacctggtggaaattagggaattaggctttgggtggctcctccagcaataacaccagacagaagctcacataataatttaaatgtttcataaaggatctaaactggcagaacatactacagtgttctttatcttttatgcattgtattgctgaattggccttaccaataactttaccaaatgatggtgcttagtgatgagtgttagacaggattgtgccccagttcttgagtggatgaggaaagattgccattttcagttgctctttataggggagatgtaaggcacaattaacttttaaaaaaataaatggggttatttttttacaagacaccttttttccaagttttaactaaagtcctctgaccaatttttctctttttgcagaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggtaaggctgacttttcacccaagtgactgatagggaagcattttatttgagaaaacatttggtttgtttttagttatttttctttcaaagcaattgtaaaagtaggctcttgactttgaagt

SEQ ID NO: 137014 - DNA, 1408 bp, Homo sapiens
gacagagtctcgctctgttgcccaggctggagtgcagtggtgcaatctcggctcactgcaacctccgcctcctgggttcaagcaattctcctgcctcagcctcccgggcaatatttatgttttttaataaaatttttttccaaagcaaagatcagttttgcattagactattccttgactatacgtacattttatggaggaaaatgtagatttttccagatttcagttaaaggaggaattataacaaggaccagctgctctgaggctgcccctgagctattacttaacctcagcccctctcttctccatagctatttttgttttctatgtaaaatgtctttgcccatttctctcagagtatgtattagcattttccaaagctgtttatgttccctcagtggtcgtcttccacccctgaagcttcttaagtctctatttttactccttagaaacagaaaaggtacatgtggaagatttctaagtttcacatttcaaagttctctttcttttgggaaagaaaaagttggaagtttaaaaatgcctctagaacaaacctatctccacattccatcaactgtataggaggcaggaaagcatgttttatgagcaaaggctttgggagcaggaaatttccattctatgatgtactagctactgccgctgggctttagtttccttatttataaaatggaaatatcaatagcgcttgccttcacagggttggagtgagcattgcacgagataatgcatatgaagggctttagccagtgtcaggcatagagaaggatctcaataaatgttagtgatgatggtggtgatgatgataaaggatttggagtctcaaaaagttgtattgcagcgttacaacataacattttcagataagaaacgagatcacatattctgccaaggttatttgaatttgctatgtggaagggaaaattacttctctgtcacttaatggctgccatatattcttactcagttaggaggtgtgcttacacgtgtttgtgatgtcttgtgtccttgccctgatggtcagaagttttgttttagccctttaaaaaatccaatacagctttcagtattctgcagtgcatgcagtagactttctacaagtaaatgttttaattaaaaaaatcaaattatcatgcaaattatactggtagaaaagattttggccttatgaacatttacaaggcattgatttttaaagtaaaataaattagcaaataaggccttataaactacctatttctggtctatttcctagggactcacctctactcaccattgcttctcttagcactttggctgttacacaatgaaatgaagttaatggtttctaataatgaatgagccatcttcatattagaggtcttggtaccaagcaatagaaaccaactca

SEQ ID NO: 137015 - DNA, 1019 bp, Homo sapiens
gatactaggatatgctacctttatttatgcataatttccaaataaatagaaataaatttaaagctattatttactgtaaattaaaaccagccaacacagcaccagggagattctgcacattttattaaattggggcctgtataggtataatgtattcagttgccatcaaaggtaatgtttctgacacagtagagggtctggttactttgcaagtcttaggttggttgcttttttgttgttttagaacaccattcaaatttaagatattactctttttgattgattctgtttgcttttatgttctaggggaaaacatatccatttcggggcgcctttccaccagtatggaatcccattgcatatttggattacaataatctgtggaggacaatagataacatggggaaggaggtaaaatgtgtgttcagtttgcacatgacccattactgaaataacaatggcaactgtttaatatccttccatagtgcagggaacattgctctggacaccaatgcatatcatttcccatgtacccaaactgcaaagttggtcgtatttccacttcacaaatggaaaaatgagtgcccagagattatgtaatttactcaagacctcatagcaagggaaccagcataccaacccactctcttatacaaatgcctgtgtgccttcaactctatgctactgagcatttatatgacatatttttgccaagtatctctacttacagttgtctgtctgtctgtaatgccattttagatagtaaaggagagaaggacttgctgccccaaagcttctttacttagtcttaggctctgtaatatcaatttgggacataaaatggttattagctttcaataacaatgatgatgataattgtcatcattataataattacatataaatttgtacatagacatatataatattatcactactattattgttttggcaatggcattaggacacagaatccaaagaactctaccccactccctgtctctatatagaattctatg

SEQ ID NO: 137016 - DNA, 1042 bp, Homo sapiens
tgatatccccaaatcacccatagtattagggtggcaataggaagattggatggtgtaggcagatggtatctactaggaatgactttcagagtcagtggggacatgtgaagatagaaaatgtgtttgcagagatactgtcttctaggaatgagacacacttgctgaggggaggcagggaagggtgtatgttttgggggcaatggtgccatccagaaatgaaccagaggagtaggggatagacaggaagagtcaatggtatgtggcaggatgctaccttccagaaatgacccacaggtatgtggggagataggaaaggttggatgatgtgggaagaatggtatctttcaagaatgactcaaagttctcaggggaatggggagacagggacgggtagatgatgtacagtgatggaatcttctaggcatagaggacagggacaagcttttgtgaaggccttgaggtgagaaggatattggcatgtttgagcaactgagtggacagtgtagctggaccatagtgatgacaagagcaagtggtataaggggagtttgcaggactggtctagaggctgatagtgcaggatctatgggccacattgaatatttgtcctttctccactgaagatcgttgaaaggttttaagcagagggttttttgagtttggcacttttaaaagccctcattggctatagtgtggaggatacaagaggagatgcaagatgaccaagtaggagccaccactgctatagcctggacatattggtagcctggaccagggctgtggcaatgaagatggagaggagaagatgggtattgaaagaagcttattgatgcttagagagaacctggattagcatacttggagctaactcataatttctttttttttttttaattatactttaagtgctggggtacatgtgtacaacatgcaggtttgttacataggtatccatgtgccatgttggtttgctacacccatcaactcgtcatttacattaggcatttctcctaatgctatccctccctgagccccccatccc

SEQ ID NO: 137017 - DNA, 1471 bp, Homo sapiens
actatccctaaaagcaccctgtaactttgtctataatatggctctatctgcatccttacctgcctggacaacctcagcccagaacacaggaatcaaaggaaattagaaacttcatcctctggaataagccctgtgcctgccccttctcagggctccctccacaccctgcactctttgacatttgaagcccacagacttgctgatattccccttggtcagggcagcattggcatagtggaacatttcttcgggttctgtgatttttataaacttgtaatggcttttctttgccagaagctgtgcagggaatgatcattgaattgtcttggtcaactctgcctctgtcctaatgaagtcttctgacagttaagtgtgcagacgttagaggtgtggcctgtgactttctggaggttttctaatcagtagccagtaggattttccttccttgggctttcataatgtttcctttcttacctacctcctcctgtaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgaggtaactcagtttagtcaaaaggagcatatagtaaataggccttgtgtcttttgcagtttctaaccagatataattcaagcagtagcataattaatgctgacatgtttccgcctcagtcttccaaattaccagccttggttgacctaccttgatctgttttgttgcctcacagttgcctcattttctcattttgtatgtttttactgctcaatgttgtttagaagtgataaagatgatttttcacgcctgccacaaagactgcagctcacatttgaggtaatattttgcttgtgtgtgttttagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaagggtaggctgctattattcatgtttaaactgtattatatgaagaaatcacagtcttttaggattattgaacagaaggtattgaacagaaacaaagtattttcaaactggtagaaaaaggattagaaatcttggtctgtcaatttcctcatatccttggccacacataatgaccccaagagcacttgttggcaatgggagggaagaaggagatcacatcagtcataaggccaccattgccctgactcctggcatctgtcctgcttcttactttttatgagcagagtgaggtcaacaggcaccatggaaagagcactgcgttgaagttacacattccgggacttcgcttgcttgctagcatcagtctgtagc

SEQ ID NO: 137018 - DNA, 1030 bp, Homo sapiens
aaggcagaagggcagaaagggcctagctagttccctccagcccatttataagggcactaatctattcatgagagcagaatcttcctgatttcatcatttccgcagagaccccacctcaaaataccatcaccttggaggttaagttccaacatttaaattttggagggacacatacattcaaatcatcgcagctagcttgtgacaaaaagtctggagtagcatatagcgcatactttttcattacaccacactaagctgacattttcttttggatttcctgctttccctccttattaatagtaaaataaataccagcctgtaggtagacatttggttatgattccacacagtggctgaacttctcaaaagttcttgtaaggcaaaacccttactaaatatgtcattgacaaaaacagtggttcccagatctgactgcatcaaaatatcccaaaagatgtttggaaaatatgtttttataagacctatagattgtgattgagtaggtttgaggtggggcctgtgtatttgtatttttcaacaagcttttcaggtgattatgataagcaaccagatttagaaaccagtgaataagttcaacgagatgatttgcacagtggcctcttttattcatcacttaggttctgttatttttagagccaaattaatcaatcagtgcattgttttaacatccttgccttacatatcttttccaaaaatttttaattttaaagggaagaagggaaagggaaagataatttcctatgtttgtgtgaacacatccttggctcttctaataatatgaaatacagtaaataatgacttgtaactattataattgtttttaacattcatgaatgaaaactaactacaatgtgggttgattggatttcaggtttcactctgctttaataaaaattttattacacatccagaaagtaagttaagcaggcctggcgcattggctcacacctgtaatcccaacactttgggaggctgaggcaggcagactgcttgagtgcagaggttgaag

SEQ ID NO: 137019 - DNA, 1077 bp, Homo sapiens
agtcatctcttcatagactaggcaaagagtaggctgaggatgggttttgactgaacaaatatttattgagtacctactatgggcagattactcagaagggtaatagccttaccctgctattaattagctgagcaaaatcaaacagatctctgcagctccctgagcctcggtttcctcatctctgaaatgaggggcttgaatcaggctgagagagacagacagacagacagtagtcttgagacttcttcccattcttcttttcctttatgactttttatgtataatgtgagcagctctttgaaggaagccaaacttcctctgactatcctgaaatttaactatccacctaaatatccatctaatgttgcatgacatcatctcaggagtggcatttgtctctcccttaaaccttccatggaaaatggtaacaataagcaaagtttataatctgcctcctcctcctgattttatacatatgaggtgaatgttctggaagttataaaaatggtttaagtgtgaggatttagataaatttataaggttacactttgtcccatgttattcagagaaattgggggcatgtctttaaaatattttctaatgtaattggcaacataaaattgtatatttctaaatctctatttctttattaccagtaagcttgagctccccccgccctgcataattttgtctcttcagcttttaatacttgtcttacagatttgactcaaaccttttgccacatttttaagcaaatatttttccagttgcttgttatcccttaacaaatattttagagcattttcaaatgtttaaactatattaaaactataaaaggtaaataggaaaagtatataactggatcagtgtgaacctatgcaaacaaatccagaaataaaaccattaatttctaaaacaggtgattttagtaaattagacttttaaaaaaattcaccatgagtagttgtgagtttaaaatgtatttcgtttcaaaaagagtttatataagtacaaccactaactttttcagacatgaaaataccatgttctgggctagtcatttagataatgaattat

SEQ ID NO: 137020 - DNA, 1028 bp, Homo sapiens
tgaatctagagtctcttcccaggtcaaagtcatactaatttgtttttccatgtgtgaactcaattcacaactcatttaggaatatcagtgctttcaatccaccactgaaagcaattaggagaatgaaattacgtctttttgaaaaaaaaaatagaatggctgagcgctctttcaggggcttgtctctaaactgttcaaataataaactttctgaatgtgccagggaaattagagaaggttctctcatgtcccctaggaaatagttttcatcttaattgccgctttttcgtggaattcccatcatacatgtttccagcttagaaaagtggctgggaaaaaagcctttcttagacatttgtttgtcttctgcctcctccctcccaccctttccttagcaataatgcctgatagatggggaagtaaagtctgttattagggactccagagatttgagcagacctttccacaagctgaattgttgatggggtttcctatagacttagctctaaagacttcagaatctgcatggatggatggatacccctctctcccagatactggaatacttcatgtcttccctaatcaagaaaatgggaagagcaaagtatacatgttttgccacatggtacttcacaaaaggccattgcttggtactatcatgtttccccttaagtgagttagaaaaacaggattttctttattttcttaatgtaaactttttgttaaagcaacgatattattgactcgcagcatttcagctttgttttctcttttgtattttcttccccactgaactgcagccagtgcattatgaagagaagaactggtgtgaggagcagtactctgggggctgctacacggcctacttccctcctgggatcatgactcaatatggaaggtattacgcaagcactacgccaattaatccaagacctgtgccaaatttaaaaggaaaagcagagttcaatgcaaattctagaaatagttgtcaaaatccccatttcttatgtcctagataatacttgtat

SEQ ID NO: 137021 - DNA, 1144 bp, Homo sapiens
gttgtcttcaagtccttgataaagaagtgcaaggtttggttttgcatcacttaaatgatgtattttccatcacttacaagttctttttggatgtctgattttctgagaaataagcacaaagatcagcaaccactttgtaaaactacctggagtgagtaggagaggcctgggttggaatggcaaaaaagaaaaacaaagacagaaaaaagtcttcttagaccagaaatctcccttaagaaattacccttccccagcccagcataccgtggcagtgtttatctcctgctatgtgaatgtcacgattgacgagagcagtgtcagactttattggaaaaaccacatatttgcagtgagatagaaatcaccgctcttctattaacatttattctgtgctatgatataatttcagcaaacaggacatcaacattgagtgtattaattttttcaaactatactccttgctttacactgaggtggtggtaaatgtgcaaggcatgccccttagcctaaggaagctgactgagacattagaggaagaggatgaaaacaaaggaaggtactaggtaatagtaacagttctctttcctctatcagagcccagggcttggctctcttccttgatcaaggccattcttttcagagtttgaaggcaaaagcaggtctcaaagtgacagtagatgtgaactggttgtctcagcctggagccaagtttctgaaaagcagctttggaagcctcatgtgaaaaagctggcttgaggaaacttgccattcattcaaggtgggctgtgggcccttcaagtaagacctccccttaatgcacgtgtgatccatcaaaggctactatttatttacactccaaacagtaacacctcaatgggaaccaggttttcctattaatgggcctcatatattttccacaaaccaccgaggtctatgggtgaaatagagtggaggaaagaggtgtgggtgtgtgctgggggatggggaggtagggacagggaaagagacgaagattggcgggggtggggtgcttaaaggtccacagagtagtgcagtaatgagaatcttgatggattgatatagggcacccctgcaccttgtgtcatttactttttacatgcccctagataagtactgtggcttg

SEQ ID NO: 137022 - DNA, 1025 bp, Homo sapiens
ggttggcagaggataatagcaggaaatctaggaaacacacacttttaggctcagacaggagagccctacacataaggagcagaggataaggaattgctaatggctactgggcatggagccttggtcctgtaccctgaggcagacccatctctgtgagaggatgggatctgagatctagtccgaggcctgtggtctgcactgggcaccttaactaccctgttttcatcacagatccctttggggcagggatatggctggcacccaggtgctgctgatgtcttgctccctggttgaatatgactttttgcacgcctgctgaatactgggcccttgaatccacctggattagcctctgcagaaccttgattgaataatctgccagcaacactgggaccctgctgctcttccctgcccgcctatctgggtcaccctactaagctgtgcatatggcgtttttggcactgccagcctggatgggttggggtggagaaagagcctcactggacccgggtgactctcctctccttggcttctcaaagaaggaaatcctggagctgagtggctaaagacaaaatgtagaaattctccaggctgacaacagggtaggacacctaaggcagaggaagtagcacttcccgcaggtacaagccccagggaaaggttcttgggccatagtctgctgggtggaccaaaggcctatagaaattatcagagccttccccgctttcatatctttattctagatttttcacccatccactttttcatagagccctttcaaatagggaacccaaccttctgaggtcaagctatgaaaagcgtcattttagcatgcctgctgacccctgggaagcactggacatatttggagtcctcttcttaccatcagcaggatcttgaaaaaggaggcagtcacccactgaaagcactccagaggaaatcaaggagaaacatgaggaagagctgacattaaggaggccggcagaaagaagagttcagagggtgatggggaaggaagaatcatt

SEQ ID NO: 137023 - DNA, 1031 bp, Homo sapiens
ttgttagaggcactgaactaacacccacgaactccacgtaagcaattcctttggaatgtcttgaatttctatcggaaatcatcctcacgcctcgagcctttcctactgtagagaaaaactcttccaaatcctttggtcgaattcctgccgccagctgcatacagaagactgtccttgcatctctttcctcaggagttagattatcaataggttccctcacagggctcttgtcttttctgagtggacttttgcttcgggaacgtcctatgcttaatttgatactataaggcaatccagtctttcctcagatggcactgttaaattttggtccgcagtaaggacttctgtagcggcctctaaatcttcaatctcgacttcttgagcggctccgtcgcctctctgcttcgacttcgcttcctttcacggcttttgctctttttcctttctcgatctgtactttgcttccgttccttacttttgcttctctttcgttcacgactacgacttctgctcttgctttttttcctttttttgctacgttcttcatggccgttggccctgctcaacttgttctcatcctacttgtaaggagcctcaagcattgcttcaatattaatatcgtctgccattttctctaaacgcctctgtcggctttcgggcgcctgtggtgctcgtgtttgggaagagactgcggctgctgccaccgccgctgctgttgctactgttacgcccctacgcccaggccgcgggaccgcccagcccgaatgtagggctgcgatgacagctaggcccaagcgaatctcaaaacaacaatggaattagagaagcccacgcggggccgggcgcggtggctggtggctcaagcctgtaatcccagcactttgggaggccagggcgggcgaatcacgaggtcaggagttcgagaccagcctggccaatatggtgaaaccccgtctctactaaaaaatgaaaaaattagccgggggtggtggtaggcgcctgttatcccagctactcgggaggttgaggca

SEQ ID NO: 137024 - DNA, 1050 bp, Homo sapiens
agcaatgcttgaggctccttacaagtaggatgagaacaagttgagcagggccaacggccatgaagaacgtagcaaaaaaaggaaaaaaagcaagagcagaagtcgtagtcgtgaacgaaagagaagcaaaagtaaggaacggaagcaaagtacagatcgagaaaggaaaaagagcaaaagccgtgaaaggaagcgaagtcgaagcagagaggcgacggagccgctcaagaagtcgagattgaagatttagaggccgctacagaagtccttactgcggaccaaaatttaacagtgccatctgaggaaagactggattgccttatagtatcaaattaagcataggacgttcccgaagcaaaagtccactcagaaaagacaagagccctgtgagggaacctattgataatctaactcctgaggaaagagatgcaaggacagtcttctgtatgcagctggcggcaggaattcgaccaaaggatttggaagagtttttctctacagtaggaaaggctcgaggcgtgaggatgatttccgatagaaattcaagacattccaaaggaattgcttacgtggagttcgtgggtgttagttcagtgcctctaacaataggattaactggccaacgagttttaggagtgccaatcatagtacaggcatcacaggcagaaaaaaacagagctgcagccatggcaaacaatgtacaaaagggaagtgctggacctaagaggctttaggtggactcattacacttttaacataactgaagatacgcttcgtgggttctttgagcctttcggaaggattgaaagtatccagctgacgatagacagtgaaactggtcgatccaagggatatggatttattacattttctgattcagaatgtgccaaaaagtctttggaacaatttaatggatttgaactagcagggaggccaatgaaagttggtcatgttattgaacgtgctgatgcttcgagtactagttcatttttggacagtgatgaactggaaaggactagaattgatttgggaacaactggtcgtcttcag

SEQ ID NO: 137025 - DNA, 1188 bp, Homo sapiens
aaatgatggcatgaaaaatcaccctatgtcagtggcccaggaagctacgggcagaattttggagcagggaggaaaactgagagactcattcctcctgaatatactcctgactagtagcacttctttctttccacatctgacttttacatgtttactacctggaaaatcatgtctcagagtctctcatctgctttttacactccttaaaattttcttcatatcaaactgacatatgttgatagtcaaaaattatcaaatcattctaaaaagcttatttcaacaacagcagtctctggccacattcttctccaccccccagacccattcacaagaagaagccactttcagcacttctagctgcttctgctatttaaaatagcatgtacatattgagtgcactgcacatgatatcataattgatcatttgcagatactgtctgctaacttcctgttatagtgactgaaaatttagcttaatattgatttacattgctatttattcttttggaatgctcttaggatcttctctttattcctagtattctggaagttcatgatgagagagagagagagagtgtgtatgtgtgtgtgtgtgtgtgtgtgtatgtgtagctatatatagattcattgtgcttaacaccctataggcttttctagtttggagtcactgtcctttggttctgagaaactttctattaattatttaataatttcttctctattatgagaactcctattgctaagattttaaggccaggtgtggtggctcacacctgtaatcccagcactttgggaggccgaggcaggagacttgagctcaggagttctcggccagcctggcaacatagtgagaccctgtctctacaaaaaataaaaataaaaaattagccaggcatggtggtacgcacctgtagtcgcagttacccagtaggctgaagctggaggatcacttgagcctgggagatcgaggctacagtaagctataattgcaccactgcactccagcctgggcaacagagcaagaccctgtatgaaaaataaataaataaataataaatagaaagattttagagctctcgaatttggatattttctctcccagattttgttttttattaggatgcatttactaagggatttccttaagtttatattccagcccttctactgcatcttttactatcatat

SEQ ID NO: 137026 - DNA, 1029 bp, Homo sapiens
gctgaggtttagagagatgaggtattttgcccaaagtcacatagtgtagaagaagaagagctctgatttgaatcctgaacttttcaaatgcacatcctctgcttctaatcattttgagttactgtctacaaatagccagtagattaggatgtcttgacagttctacctcctccttactgcttgcttctactctctcctctccatttccactatcatcattcttgttctgacccacattgcttcttaaatactgcggtgccaccacattggtctttcatccaccagtgtctaaatgtttaaatccatctttacatatagcagctaagtaccttctaagagcaaaaatgtatgtcatcttattgcacttttactcacaaaccttctgtggtgtctctttgctctctaaggaaggaccagctctttaactttgaattaagctccttctccatagtggggcttagggttcgcagctggagcattgttctcaaatagggtctgaagtagggagtccttgtttgagacaaaaggagaaaccaaaggaacagataaagccaaattctatgtcagggaactagggtccaaggtatcaggagggaaacccagaagagggcaaatctagttggatgtgtatgtgcattgaatcaacctggaataattttctagattatcagttctatttgttttgttttgattttgtttttgtttaactctatttgcttttatttgctagcagccgtgtgagggatcctgccgtgaaggaactgagatgaagtaggcaggccttggactcagagttcttcacagatatcatcccccactcccaaaactccccttcctgttcccagtagtccagccacatgggccgtttagcatattacacatatacctcctgccttccccctcccccccccttttttttttggccttttcccttgctatttcatcagtaggcaatagctcccaatggttttcacttgctgaaagcttgctcttccttcaagacccatttcaagtggcaccatatccatg

SEQ ID NO: 137027 - DNA, 1056 bp, Homo sapiens
cctgagctcttgataatgtctgtgcctgttattaacactttgtacagcttctcagatgtattataccatcttcttgccctctttttttttttttttttttttgagatagagtcttgcttcgttgtcgcccaggctggagtgcagtgacacaatctcagcttactgcaacctccgcctcccgggttcaagcaattctcctgcctcagcctccgaagtatctgggactacaggtgtgcaccatcatgcccggctaatttttttttatttttagtagagatggggtttcaccatgttggccaggctagtctcaaactcctgacctcaagtgatccacctgcctcagcatcccaaagtgctgggattacaggtgcgatccactgcacctggctcttcttgccctctttgaatctttgaggatatgattctttctcccattcctctcagcctccttcccttactcagctcccacttctctggttggcagattgcctttcatcttcaagatctgctctgctaccacctctgctgtgaagctttcctggatttctcgctatatgtatacacatgtcagactggatgaggggtactttctcggagcttttggacatatctttattgtagcactttttctgcttccttgacttggctttccctctagtctgtgattaattctaggatgtagatattgagggttgggggtcaaatctggtccattcctctattattctccatcatttgacataaagttaatatttaatcagtgtttattgaatgaatgaatgaatggattcatggacaagggatgtgtgcagacagaacacaatagaagaaatatttcttaacaaataaggggaagagatgttgaagtttattagtaatcaaattattattgattaaaatgagacatcatttttacttgttgaattaggaaacactttttatggccaggcgtggtggttcatgcctataatcccagctttggggaggctgaggcaggcagatggcttgagcccaggagtttgaaaccagcctgggcaaaacaaaaagccaaccccg

SEQ ID NO: 137028 - DNA, 1032 bp, Homo sapiens
gttggtggaccaaggctgggaaacattaatataatctaccctattgctgtcctttacttcacggaagcaaattgtaaatttagtgcttagaacatggtaatgatctcatcctgatttatctaggacaattatctctccttttatatggttttgccctatttttatttggactactctgtgtacattgctattggtgttttttattgtaagcaatctagcatcttttaaggaagccactagtctatgaatctatatgaacaaaagcaaaaacaaagacaaataaaatcccaaagcactcaaacataggttcttatcatgaactaaatagattcttggacagtattcatagcctgtcttcaaaatggaaatttccatatatgtttttgaaaacagcattttgaactttcctaaaagcattaaatataaataatgtgatgttgtagaaagaatgctagcctgggaatcaaaaagatggagatctttgatttgattctgtcactgtctggtggtggtgtttgtattggtgagggcttagttttaaaaaggaatatcctctctggctagttaagcaaaaaaaaaaggaatttattaaaaggagcctgggtggttcacagtgtctttggaagggctggagaaacaagctcaaggctgaactataggaacagtgcccaaaacagggctgtagaacttgtctgatgagaaaatgacctctgttaccaccacccatgactcattgctgcacttgcattgctgccaagaacttgattttaccacagccataactaccactatttctggcaatcgtcctttaccacccctgaaggctgggctcctttgacaccaaacgtggcccaccctgagctgcttttcttctgttaatcccttctgaggcacagtcttaagtaagcttccctgattggtagagagcctgggtcacctgcatatttctaactgcaaggaagtctgggaaattgagctctgacctctatgttggggtggtaggaaacttacgtgggaatttccccaaatata

SEQ ID NO: 137029 - DNA, 1516 bp, Homo sapiens
tgccagagtgaccttcctaaactctgatcggatcattcttctgctcttaaccctgcatcagtgtgtcacatgagtttgcctacctttagctccgtatttccatctcactagaagaatacttttgtagaagccaccatgtattgagcacttactgggggctaagcatcgtgctaaatgctttatacctactcttcactggtagcctcctgtcaagttgttacttgtttgcttccctgcctccacatcagctcctgccaagtgcaatagatgtttgctgaataatttaatgaacgatcctatttctcaaggaacgttcagtctaaagcttgcagcaatcaagtaaataattgatttccttgcaccagggaagggccatctggctcttacttagggaagtaaggagaagctaggcctgatcctcactagccaagtaacttgggcaactcacttcacctacctgtatctcactcatttgttcatatattggtctctgaggtcccttctaggctctgacaactggaaactctgaaaatgtaagtttataatattcttgtaaaatgttctcttttcaaatttgtacattgagatagtagagaagagcagaggcaagcaaaggcaggactgcagcataggcctatgggcttggcctctgtggccctgactctcttctgcttagatacctggcactctcagcatacacctggggcttcggggcccagacctgctgctctgggcagtggtccaagcccccagcattgccctttttctcagagatgtgcatctcctctcagaaaaactttgagggtaggagctgataaactacctctgtataaggtgccatggtcaataatggattaatgtgtgggcctctcggagatatttgcctcagaatagacctgatggaatgcagggacaggcagccatcaggaaacagaagtagggaatggtttttgttttttttttttttaatttttttatttgggtagggaacatttctcttttgccttgtgggaattcaccacttctgcttctgtttcattgatcctctttagaatctttttggcatggtctatcagattcgcctgtgagagctgctgatcgttatccaagagagtgcagataacctttcttagagccttaggatagatacctggtggcagtggtgggcagatttcagcagggagcagggcagggactaagcttggcagggctagtatttcatgcagttgggaacataggcagggtggggcttcccagtgagggccctggactctgaaccacaggcagcagcagcagcagcagcagcactgagagcccaatgccaaggaagatgtggtcagtccatctctctggccacctccctgagccttgatctacccatcagagatgacacctggccccatgtagcctgtgtgtattttggttagctgagtgcttgtctcttctctccacctggggaagctctcagagggcagggcccatgcctggttcactcttgtgtctttcccagatgcct

SEQ ID NO: 137030 - DNA, 1018 bp, Homo sapiens
ggcaatgctgttcggtaaaaataacatattgataaaatcttgattttaaatgtggactagttcggtgtacaaacatgtttatttgggagtcattgcctaatatggaaaaatctatctggaaaattttattttaaaagtttacctataagtgataatatttatgtgccatttatatacatacagtgccaattttgtctcatttatatataaaatggctggggttaagttgctaagattgatgtctctgtgtacatcacatcattcatatcagtttggatcctctgagaagcagacgccaagacagaatgagaagtgtgagagatgttgtggtggaaatttctgagaaggataaagggggagggggcaggagtgggcaggggggaccttcagaccgggaggcaggttgaacccctatggaaggagagcgaaaggaaggaggaggggtgggtagggagagcctcagctgacaacacagctctgagaaagtctcaaccaggctgatggggagccccagagcacagactgcccatcagagaggtcccctgtcaggcaggaatcacctggttctagtccccctgctgtgctgtgtcattgggtgggaacagcttggggagagtgtggccccagcagcgacattgcctgtgaactctgtgtgaatccggaaggtatggcagctggagtctgtcagccaacaatgctcttctccacagggtctctcttgataggaggcctgagaagcgccctccatggctgccatgccatctctccatttgtagtcttagggattcaggttatcataaaaccttgaaccagtagctattcgaaaacactgaatctagatgagaaactcagtaattgggagtttagatttctggagaccagcaggcctggcttgggaacctgactccacattaatagctgagggaccttagatattgtatttttcctgaacttcagtttcttcatctttggaatgggaggaacaacagtgcctgtttgatagaattgctatgaagat

SEQ ID NO: 137031 - DNA, 1064 bp, Homo sapiens
taagaaacatttacaatctattctgtctgaagcctgcttcctggaggctgcatctgcatgataaaacgttggtctccacaagcccttatcataacccagacattcctttatattgataataactccttcaaccaattgccaatcagaaaatctttgaatctgcctgtgacttggaagcctctccccggctttgtgttggcccgcctttccagatcaaaccaatgtacatcttacatatattgattgatgtattatgtctcactaaaaatgtatgaaagcaagctgtaccccgaccaccttgggcacatgtcgtcaggacctcctcaggctgtcacaggcacatccttaaccttggcaaaataaactttctaaattgattgagacctgtctcagatactttggggttcacaatgccaatgctgatttcctgcatttttgttcttgttttaccatgttgcagaaggtaaaatcctggttttgataaggtatatcaaactgttatataagatgttatcatcggggaaagctgtgaaaagggtattcaggaactctctgtactatttttgtgactttttgtgagtccaaaattactttaaaaaaaatttttttaagaatacagctagattatatggtctatggcatttgtgctatcacccaccatcagcgttacaaaaagtgagtttaccatagggcagagtcctgcaaatacaaaataaaggaaggtaaataattttttttttaatatttcaaataaacttgcagctggtttgaactcgggggggaagaatacataaataaccatgacttttatagattaaaagttcagaacaaaatataaatcagcctaaaatttaagtcaacaagtcaaatagtgactatcagtttcttcctaatttgtgaactaaaatcttataaatgacaaggattttatgttcaaaataactataattagtgtgcacagaggatgaggcagcaagagggtagtcatctgtaagacaagaagagaggcctcaggagaaaccaaccctgccagcaccttgaccttggacttccagcctccagaa

SEQ ID NO: 137032 - DNA, 1047 bp, Homo sapiens
cagacgaaagtcatataaaaacattcagtcatttgtatatttctaaatattccaacgttttataaaagcagctaactatagatcttatacagccaccatagcgtagcataaactgctaaatgccaaatttcaattaataatgaagtagtgggtgcctgatgtaattagagagtcctaggccattagatccagggtctgggctcagttctaggataaacaagctgaatttgactttagtcaagttttagacgtaaattgccagaggtaaaagggccttacagatcagctagccaagtcctgcattatagttaaggaaactgaggctcagagaggtaaagtgactaagccacaatcacacatatagttaatggcgggaccagaaccagaatcagtgcctccaacacccagtctcagactctggttcctgctccatttctccttgagaatgattcttcatttatatgatgaggacaaccgtctatatttgcttcctactcatggaggtactgggatgatgactggaaataactggcgtgagtgatgcattttgtgacttggacagtgttcgtgttctgtgttcagacagttatgattatggaatagtcttgtttttgtcttggccccatcatagtctgcttttatttaaatgaattcaatgaaataacgaagtctttgaagggtgggtgcagtattaagcaaaattcttttgcctgtttttagaaattctcccaatgctacgggttttaagcaagtagtacacacactgtgtttctcggtggaaacagtattggcatttgaggtagaacaatttttccccaatgtagggttgccttccccacactgcaggatataaaatatacacttggcccctggatactcaatggtagcagcacctcctggtcagggctggccctagggtgaggcgatttaaaacatcaaaattaatgcaagccaggcgtggtggctcatgcctgtaatcccagcactttgggaggctgaggggggtggattacctgaggtcaggagttcgagaccagcctggtcaac

SEQ ID NO: 137033 - DNA, 1004 bp, Homo sapiens
gataatttcactgtactcctgcctaggcaacagagcaagaccctgcctcttaaataaataaatagataaaactgaccatgaaccaaaaattgctgtattccgatgatgggaatctaggggattattatgctcttctctctgtctttgaaaatatttgaaatctttaaatgataaatataacataatataatataatataatataatataatataatataatataaacacatagaggcagccaatacttacttatatctaattgactattaccacatggaaacacagtaaggtcagattttctaatgttttaagagaattctgaaatccagattctaatgtaaaatctttggtgtttactgatccatttgtttaatcatagggcacaaaaaaattacatctggagcttgaattcagcacacagctcccattttgcaatgtccaatttagaataattgatggaattaaatggattctgaggtcatccatcataaaagtaatttatcttgagcatatgtctaacattgcatattttatttttaaaattatgatctgtttccaaaaagtgcaaagaataataaaacaatcactcatgtaccagctatgaagccttaacaaatcttaatattttaccatatttacttcaaaaagaaataaaatattatgaataccattaatgccctctttgtgcctctccttgattcctttccctctgcctctctaaataacactctcctgaagtttgtgtccatctttcccaaccaaatttatagaatttcacggaagttgtcatgtatccaaaaagcaataaatgtgttgttttcctttttctagacgttaaatagaggcttcattccatcaaaaaaatcaattgcatttatatctaccaacaacaaacagctagaaaactaatttttaaaaagactattaagaataatattaaaaagtgacatggatctaggaaaaaatctagcaaaagatgggcaagacatttagggagaaaatc

SEQ ID NO: 137034 - DNA, 1139 bp, Homo sapiens
gcctaaaaacaaaaaaaaatagatgccacagtttctactttgcttcactgttttaaatttaaaaacaaacacaaactccaattgctaacataaaatgatagaattgaaccatctcatgttctgtttcttttggtttacaatcactatgatattatttcttatttctaatttactctttattcttaggaatatgcagtaccacagtaattagagacaaaagtggtgcctaaaccagctctcacaattgtgaaccattataaaattaatatccgaacaaatacatgtgtctcaatcctcatgttttaggggctgactatatgcctgggaattctggaagctgactaccatttagactgcagtgtttattaaaggataagtaataaaattgtgctaaattgaagctcttaatatattattactaggcaaccaaaaccacagcttttgtttagaccttaaacctgctctgtccaatacaatagccattagctgcatgtagctactgagcacttacaatgtagctagttcaaatttaaatatgctgtgagtggaaaatacacatcagatttcaaactctaagcattaaaaattaggtaaaatattctattaaaaatttttatattgactgcatattaaaatgacaatgtcttggatatgttgggttaaattaagtatattattaaaattaatttcacttattcttttttcaatgtggctattgggaaatgtttgttattaaattttttattgatacatagtagatgtacatattttgagggtacacgtgacaatttaataattcatataattcacataatttgtaaagatcaaattcatgtaattgagatatccattaccttaaatatttgtcttttcttcctgctaaatactttctaattatcctcttttagctattttgaaatatacaatagattattgtacactatagtcactctactgatctatcaaatactagatcttatttcttccatcaaactgcatatttgtacacacacattaatcaatctctctttgcctctctctcctcaaccctttctggcttctggtaaacatcaatctactctctatcttcatgaaatccatttttaaagctcacaaatatgagagaacatgcaaatttt

SEQ ID NO: 137035 - DNA, 1156 bp, Homo sapiens
tgaatagtcatattggacatctttttgttgttggcttttcaagcttcctttttatgagttaccaattcatattctgctggcttctttttccctcattgatttgtaggagcttcttaaaaatactctttttaagttttatgtgttgtaaatagcatctcctagtccacagatttatttttcactttattttttggtgcattttatagtccagaagtatgtaactttagtacagttgaatttattgaccttttcctttagagtttgtgccttttatattttaagaaatcctgaccgagcaggaacccacatccaggaacagagccctttgctcctccctcagaatgaatggagaccagaaatcagatgtttatgcccaagaaaagcaggatttcgttcagcacttcccccagatcattagggtgctgagtgaggatgagatggggcactcagagacaggagatgctgttgaccggctcaaggaggtcctggagtacaatgccattggaggcaagtatcaccaggatttgatggtgctagtagcattctgggagctggtggagccgaggaaacaggatgctgatagtctccagcaggccctgaccgtgggctggtgtgtggaactgctgcaagctttcttcctggtggcagatgacatcatggattcatccgtctcccgccggggacagatctggtggtatcagaagccgggcatgggtttggatgccatcaatgatgctatgcttctggaagtatgtatctaccacctgctgaagctctattgcccagagcagccctattttttcttttttttctttctttcttttttttttttttttttttgagacagagtttcactcttgttgcccaggctgtagtgcaatggtggaatcttggctcaccacaacctctgcctcccaggttcaagtgattctcctgcctcagcctcccgagtagctgggattacaggcatatgccaccacactcggctaattttgtatttttagtagaggcggggtttctccatgttggtcaggctggtcttgaactcccaacctcaggtgatccacccacctcagccttccaaagtgctaggattacaggtgtgagccaccgcacccagcctggagcagccctattacctggacctaatcgagct

SEQ ID NO: 137036 - DNA, 1363 bp, Homo sapiens
tttagaaatgatataattattaaagatattaaacagactctgctgatgtaatatgataccaatttttatgttgttttttttcctggagttattactttgttataagtgtaataattgtacatttcttttttgttttttttttttttttgagacagagtcttgctctgtcacccaggcttggagtgcagtggcatgatcttggctcactgcatcctccgcctcccaggttcaagcgattcttgtgcctcagcctcctgagtagctgggagtacaggcacgtaccaccacacttggctaatttttgtatttttagtagagacgaggtttcgccatgttggccaggctggtctcgaacccttgacctcaggtgatccgcccgccttggccacccaaagtgctgggattacaggcatgaaccaccatgcccagccataactgtacatttcaaaaaaggctcttctgaggaaatactataacatgtctaaagctcttttttcttttttgatgtctgtagtttaaaaaatatcttcttatatgtaagcttctaattttcttgtttgtttgtttatcctggcagtctgggcagaattaattattttggggttacatatagttagatcactgattcgtttaattaaccttgaatgcatctgcttttcatttctaaaaatcattattttggtcccttcattaccaagaggccaaagtcactttaaaatacttagtagcatagtatgaatttactgtctgaagaacagtgattttataaaaaatataattgtgaaattgcagcttaaagagaattgtctcctcgatgtaatctagtgttagatgtcaataccaagatttcaggcttttgatagcattatgttggttaaacactaggccagttcacttatttctcagggctggtatcatacttcctcagaggctcctttgcccaaaaaagctttctgtattgttagttttgcccatagagttctaggttggaattgggaaaagcagcagaacaacatgtattagagtcttcatattagaaagtctttgcagatattcagaccatctcctttttataagaagtccctatagtatattttgtgtattgtaaacatatgacatttcatgctttcaagtttggttacaggctgcatgctttcgttatcgtgagactccttaacatttaatgtggcctctatctttggtttcttactctcgttagtgcctcagatacaatgctaaataaaactgggactttcttaataggaagtgattttgcttataaatacttgttttttctttttttttttttttttgagtcagagtctcgctctgtcgcccaggctggagtgcagtggcgccatct

SEQ ID NO: 137037 - DNA, 1049 bp, Homo sapiens
aacaaaacaaaacaaaaatccataatcttatatctgaggcagatagatttgaagttttagttttgttcatattcttgtaagtataagatctaaaaatgctttgccattagaggatgtttatcagggcatcatctggcattcatgtctgtttggcatgtattttttcaaaaatatcattccttgaagatcaaatatagtaaatccaaaaattgaaaatctctacgaatgaatgtgagcagcacttttaaagatacagagaactgtcacttgtactagattttaaaaatgattgatgttcatagccaccagaatctgaattcagcacctaagccatcgatcatgtaataactagtgtagttgtagtacaaggggactagatttgtatgtatgaagcacagattttgagttgttcactaaacagccttttaaaaatatatatgttttctttcttttggtgacattattacgaataattgcttattacttgtggtaagaggtaaaaaaaatgattaatacctaaatttagttctttggatgaatatgccagcattagtacagatgataattttacttaagctgattttgacttggttttatatggaatcaagagcatattttattccatagctattttgaagactcagttgtcatttctgttagtgtaaaagggtactggactgaagcagagtttcctaaaatgttcacagaatggagagaagtgtatattttaatccactctgcatgtcagtttttcagaagtccatttcagttcactcaatatgcaccattcaaatccacattttgtcattgccacctcccacttttccgcatttagtacacgtagtctttgaagtttttaaggcagagcaacataggacctatctgcatcaaaccagtttttcccacaaatacgactaaccttgaaaactcagtagaaggaaagtgaaaggggaaataaagtaacaaatggcttttaggctaattgcctaatattctttaggcccactttcatatttttatgacctttcttatatttaaaggtaaatatt

SEQ ID NO: 137038 - DNA, 1057 bp, Homo sapiens
cctgccttaccttcacctccggcccttcatctcccatcttcaaatgtattattttctttttttaaacgtctggactcaagtgatttcgctgagctccagactagttctctcaggaggacccctccccacccccattcctcccactgatgaaaatggaccctgctctgaccttgaccctactaaggtttggaggtgggggtgacccctcactactgtgtcattctgagttggccctggcttcgtgaccccaggctggtccccgggcctttgggaaagcagatgggggtcattgttgcagggtcctttactcttgaggccctggtctcaagaattgagttaaataaagtcagtagtttctatgtgggcatttttagctgtaggccagaactaatgagttgtaacagatttttaaaaagatgtatagaacatttctgacttttgattgactctacatttattttttgcattttgctattttgaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgagaacaacgtctttttcattaaatttcatttgggggcctgacactgctgtcctttcatacatgggcaagaatcaccgtgcacaggcagtaggtctacactgttaattccagaagaggcttttctctgagttaaaattgatgtaatctacattcccaggctccctgttgagttttggcgatcccctcccccatgcccaccactgttcctcttctccctcctcatccttcttttgattctttatataatttccccattctcatgttcagcaaatgtcgtggatctgattcagtgatagtagataggaagaaatatatgagttaattatatgtaaatttttacatttcattcagtgctaactgctgaaaaaacctaagaaactcccacggtagaactggcctctagtattgtcagccc

SEQ ID NO: 137039 - DNA, 2376 bp, Homo sapiens
gcggcgggaaaagcgagcggcgagagcgaggaggcgtcccccagcctgacagccgaggagagggaggcgctcggcggactggacaggtacgggccgccgtcactcgcccggtcggctccggacgggcagtagccgctctcccgggaggaccgagcgcggcttgtctctggcggcggcggggcgggcacctcggtttggcgctcttcgcgccgcctccgctggggcctcgggctcgggcagggacgggtcggtggcgttccctgagcgttaacgagtaaactgtgtctgtctccacagccgcctctttgggttcgtgagatttcatgaagatggcgccaggacgaaggccctactgggcaaggtaaggcagctgcgagtcggagcgcggacaccgtctccctggccggcgccgcgctcgccccgggccccgcggccgggtctgtgctcattgtggccacggacgatggtcgaggggcttccggaaactatttcctgcctctgctctccccccacccccgggtaccctgcttgctcccttgcgaaatcgctcttttcctcttgtagctggaggaacagagacgggatcgctttggggccgggctcaactgggtcgacacaactgcctgctattttacagctttttgagggtaggccgatgatcttcgaggtgcctgtttagggtcaagggatcgtgagtgtgttcagattttcccaaatttcggacttaacttgcctctacgggtttaaaaaaattcttttccttcaagcaggctgttcgtgatgcctactgctaaccaaatgttttaggctttcttgtgtccccgctcccagaagggggaagtttcacggagtttaggtcggtgaagagtttgcattgggctgttgacatgtatctcgattgcagtgtgtgttacctgaagttaggtgacttgtttactttttgggtctttttggcatagaaataccgtagttatttgtaaacgtgttctcttcctggagcctcatttcctgtgtgtctgacaggggaggctggggaggattcggggtgtagtctttttttatttgtgtggaaagttgttggcactgtcatttagttaagtaatggctgctcctatcggcccaagatggcgggacagggtgggaggagaaagtgaaggggggggttagggggagggtgtagaggtaaacatggaaataaatagtagccgtgaataagcctttccttcggagtgtgtagctcagtggtgtttaaaaaaaattacccaagattatttgcatatagaattcttatacctttcataagcttggaagcagcatgcataagcctggtaaatgcttatcaacctgtagcacatttagttatccatctgtaagctattgaacaaaggctggagtctcaatctgtatgcatcagtttatatttcctgaccaaaatctgattgcaatggtatttgaatactttcttcgtaattgggaccgtgaaagttggagtgtgtgctatgggtgttgtatccgttagacattttcttttctagctgaaatcatagctttgcatttgacacctagctttattgttgcagttgagacgcaagtttgaaataagtctaacattttattcttaagttgatttttttgttgttctgaatttttgtctgtagcttggtttcgcagagtcatcaattcctttttatctgtaattacacatttgtttttatttcaaagtaattataaggtgttatattgcatataatcagaaaactaaatggaaataatgcttttcagtaagcccggcccctttgaccgatacagaaaacttgaattaaactttgactacgtaggtattaattggcttcattacaattattgctgtaaaaatgaacagtgactagctctggaaagatttaagcgtcagtaattgttggtctcctgccttaaagtttttttttttttttccaatttgagtatttaaagtattttatttaaaaatatttgactgctgtcaaagttgtcattataaaagattaaacatgatttaaattaaaagagcattattttgttttggagggattattgttggtctaacatgggttaataaaattgcttgcaaagataattcacgtggaaaagtttggccaaatcgattgcttttggttatggtgatgaaaaaataaatggaatctgatgttttatgttgagaatgtgtaaaatgctagttgattttatgtcttagaatgctcatattcatatagattcactgcgaatagtgcttaacattggatttcggattgtaatattaaaccctgcagttatgcactaacgagtttaaattttaaaaaagtaaccattttcaaatattcttggcaagttgtgcattac

SEQ ID NO: 137040 - DNA, 2398 bp, Homo sapiens
aattcttattcctatgtatattattggattttctttcaagtttttaaaattcacatttgtatgttaaaaaaaactcttgacctaaaagctttagaaagttgaaagcattaaatatgtctcttacttgtcccttaacatatgtacgtatacatatatacacacgtgtacatatacatatatacacacgtatacatatacgtatacacacatatacatatacgcatatacacacgtatacgtatatacgcacgtatatgaatacgtatatacacgtatacgcatacgtatatacacacgtatacgtgtatacatatatacatgtatatacatacgtatgtatatgcgtatacacatatatgtatatatatgcatatgcgtatgtatacgtatgtacatatctatatgtgtattccttttccaggtgtgcagtttattcaaaccactgatttctcatcgtctcccgaatgtttttgtcagattcagttatattagagtcattgaaagaattttttgtttgtaggatggccatttgatatacaatgcctggggttttggattaaaaaaataaggtagttaatacaatgtattattttttggtaatgtctttaaggttgtaaacagctagagcctgcgtaattagagttcttgtgatatagggtgatcttgaacagtgctcttgaatgctgacccttaatcttctggtaatgtaataattcaagattcttatttttaaaatttcagtggagttatcgaaaactaagcaaaatattttaacagaaattaacttgtgacttttttagtacatttttgaaaaccttttgggtttttttttttttaagtagggtaaggatttgagttaaagtagaatatatacgaatatataccataaatgtagtaagtttaaatatagtagtactaccaagtatagttatagtaataatgctaggggactggggaatcttatctgcgtcagggaactattgctaaaatacacagttttgaacaaagtatcttatttttaagtttttcttaaatactcttattggaaatttttttggtaattctattagtagaaagattatacaaaatacttagaagttatagattgtatatcacttaaaaatgtatgtgcttttttccgtaggacatattagcattaaaacagttggtgttttaaatttttttgataatagaagtagtttaagatccattgaaacatattttcttaaatttggtttgctggcgtgtttggtaggggaaattattaggtcagttctagaggtggcttttttaaattgtaatatttggatgttgattaaaaacattctcatttatgtgtgttttttgtttgctggcacttaaaggcatacaggttgagtatcctttatccaaaatgcttggaaccagatgtgttttggatttgggatttttttgggtttcagaatatttgcagaatacataccagttgagcatccctaatctgaaaatctgaattccaaaatgctccaatgagcatttcctttgagtgtcatgttggtacccaaaaagttttagattttggattttcagattagggatgctcaacctgtaaattcatttccagtgctaaagatggctagtgttttggttagaaaagtcatgagagcctgtctcaaaaaacaaaaacaaacaaaaaaagaaagtagccatggaaataatgtcatgctttgtgttttaaagagttttctagtttggaagattgtcttctgaacacttgcagtcttaattttttacgtggacaaagtcttatatacttggtatttcctaaagttttgatttgtgcctggtaataaagatatactaagattatagaacatatttgcatatttggtcacaaattagaactgcagcaatacataaacaggcacttttaaagttctggttttctttttcagtaaatagttctttctgtcgaatcaattacaaattgaaataactagagagcatttgactgccacctctagatactttttgtttttttttttaatttgagacagtctcacactatcccccaggctggagtgcagtagagtgatctcggctcactgcaacctcggtcttccaggttcaagtgattcttatgcctcagcctcttgcgtagctgggattacaggtgcctgccaccacacccggctaatttttgtgtttttattagaggtggggtttcaccgtgttggccagactggtctcaaactcctgacctcacgtgatcagcccaccatggcctcctaaagtgctggctttgcaggtgtgagccgccgcacctggccaatatcttaagctgttaagaaaaactgcctgagagatgaatttttgtgacttaggtgaagtgataggtcatgcactttaaaccaaaatg

SEQ ID NO: 137041 - DNA, 1098 bp, Homo sapiens
aaagtattgcaaatcaaccatcacccagctttaatagtttgcaactcatgaccagtcctgtttcatctatatatattttgcccctcactcatgttattttgaagcacatctcagcaatcagtcacagcatttaatccatagatgtttgtttctgaaacataaccgtgatgcccttattacatgtaaaataatttcttaatctcaaatatctgtggaccttgttttttgctgtatggaagttaagaaataattgcttggaaaatgagtagaaaacatgtttagctgagtatgtgatgtgaattttgtttgtattttgatactgctatagtgttctgtgatagaatattacataatatgtgacacaagaggtaatttttcctgagaactttatgaatcatagttgcttgagtctggatagtttttatttttagggaaaatttgttttcaagatacagtagttaaataaatattttaggtttctgaatttcaaatatcagaatgagaactacaaaagcttttgctttgcttgattgattggtgaaacatttgttgagctgctgtgggtgagggattgtgtcaggttctggggcaaccaataagacctggcctctgtcctgcagtcagtctgttgggagaggctgacagactgagtgatcatatgatgtattaagtgtaataataaagatacatgcaaagtgctgtgagctctgaaatgatggagtaattaaaacatttaaaactttttattatgcatcatttaaagtatgtacaggtattgaaggtagtttaatgaactcctgttttcaacggttctccacattttggagcagttaagtttttttttttttttgaggcagggtctcactatgtcagctgtcacccaggctgagtgcagcgatgctatctcggctcactgcaacctctgcctcccaggctcaagcaattctcctgtctcagcctcttgagtagctgggactataagcgtgaaccaccaagcctggctacttttttgtatttttttgtagagacagggtttcattatgttgcccagactggtctctaactcctgggctcaaggtatctgcccgtgtcagcctc

SEQ ID NO: 137042 - DNA, 1375 bp, Homo sapiens
cgtggaggctcacgcctgttgtaatcccagcactttgggaggccgaggctggtggatcacctgaggtcgggagttcgagaccagcctgaccaacatggataaaccccatctctactaaaaatacaaaattaaccgggtgtggtggcgcatgcctgtaattccagctacttgggaggctgaggcaggagaatagcttgaacccgggaggtggaggttgtggtgagccgagattgcaccactgcactccagcttgggcaacaagagtgaaactctatctcaaaaaaaaaaaaaaaaaaaaaaaaaagagttagaggtataaagttaaatggtgtttgaggaattgtgaatagtcaggtatgggtagagggtagcatgtttcagtgggattgggaaaagataactgaacatgtgagaagccccatcactataggccgtaggatgttttggggcattgttaaactgaactctctaatcaggtgaagtgacatgaccagaagtaggttttatgggaatattactggccactgtgagaaggatatggtgtaagggaaaggaacttcagtaccgatgggtagatagcaatgcatgaattttaggatagaattctgttcctaccacttactagatgtgtgatccttgggcaagcaagcatctttcagagcctcagttttcttatctgtaaagtagaagtagtaatacatttcccgcagactattgcattttgtgttaggggaaaaaatgtaaagtgtgtggcattgggcttggtgcatgaaaggtgctcagtataagataatatcttggataatggtaacgtcttggaagagacgagtttaaactaaggctgtggtttaggaatggggtgagatggaggcagacttaagagctcttgaaaaaggccttttcttggctttcataacatccttgctactttgactttgtatctgacaacatctcagtctttgcaaggatgctgtgttttaggtcctctttactcaccctgttcccaatttacatacatgtttgactgcctacttgactaccttggtatcttgaaggtatctcaaactgaacatatgcaaactgaatttataattgtctttaatattccttgtcttagtaaatgtcacttaccactacccatgccagaaaccttggaatagttgttgacatctctttttctcaattcctaatcacccgacctcatcatttctattttttttttttttttgagacaaagtctcactttgttacccatgctgagtgcattggcatgatcactgctcactacagcctgacctcccaggctcaagtggatcctcccactccagctacgtgggactataggcatgtgccagcacgtgcagctaattttttt

SEQ ID NO: 137043 - DNA, 1050 bp, Homo sapiens
tctgtctcaaaaaaaaaattcctacgtcatctctcacttacttagttctttttttcagaggcagccactgataaaagtttattgggtagcttttcacttttaagcatattctgttagatatttttatcacacaaatgagatcatattgtatattgttaaaatgctttgttaattttacctcttgctatatgaaaatactggtagtttttttttttagatggagtcttgctctgttgcccagggtggagtgcagtggtgcaatcttggctcactgcagccttcatctcccgggttcaagcgattcttctgcctcagcctcccgagtagctgagattacaggaatgcgccaccctgcccggctaatttttttagtagagacggtttcactgtattggtcaggctggtctcgaacccctgaccttgtgatccgcccgccttggccccccaaagtgctgggattacaggcgtgagccactgcacctgacctactgtgagctcttgattggaagaattggcaaattttgccttcatattttggttttattgctctgactgattaccaggccccatgaatattaattcattccgtgaatgtgtatagaagtagccatagttatactacttactatcttttttttttttttttgagacagagtcttgctctgttgcctagactggagtgcagtggcaggatctcggctcactgcaaattctgcctcccgggttcaagcgattctcttgcctcagcctcccaagtagctgggattacaggcacctaccaccacgccctgctgattttgtgtatttttagtagagacagggtttcaccatgttggccaggctggtcttgaactcctgacctcagttgatccacccgcctctgcctcccaaagtgctgagattacaggcatgagacaccgcgcccggcctacttactatcttgtatttgtaagattcatttattttcattatttcttcttggtttttattatagaaaagagaaaataggtaaatttgggttcttgattagttcaaaaaagtatagccttt

SEQ ID NO: 137044 - DNA, 1203 bp, Homo sapiens
gggaaaaccgctcgagcccaggaatttaaggctgtggtgagctgtgattgtgccagtgcactccagcctgggcaacacagtgagactccgtctctttaaaaaacaaacaaacaaacaaaaaactggcagagggcagtggctcacccctgtaatcccagcactttgggaggctgaggcgggtggatcatgaggttgggagttcaagaccagcctggccaagatggtgaaacctcgtctctactaaaaatacaaaaattaaccgggcgtggtggcgggcacctgtaatcccagctactcgggaggctgaggcagagaattgcttgaacccgggaggtggaggttggcggtgagccgagatcctgccactgcactccagcctaggcgacagagcgagactccctctcaaaaaagaaaagagaactggagacctgagttttaggacctgctgtgtatttcaatcacttaatttttatgtttcaccagttttgccgtttcttaaaatgaagggctaggaattaggaatttccaaaatgactgtatagcaccacaattttgtagctagtttttcatttgtatttttagggttgactcagttcttgaagattttgacctagaaggagggcacaattaaactttgttttagattataattttctttgattttagcctcaagcttttaagaccagaaactgaatgaatgcacataatgaaattgagatttgtatgcttttgttaatctaggttgcatgtttttgttaatataagattaaccatttagttagttttagactggtttgaaagtatttctttagtgttttgacttccccaaaccacttctttcttacagttgggattgttatttcttaggtcagatctgatgtttaaaattctaggcataatcactgtatattcctgcttgctagaactcatgtgatggcaaagttaagtgaattctcaggtatgaattgataagaaatatcacattgaataaatatatattaggtactgggcatgtagatattacaaagatgagtaaggatccttagtttgcctaagagtagcaagagtcgcttggcatcagctgagacactttctgatctattgaaagtaagcatttatttatttatttatttatgatggagtcttgctctgttgcccaggctggagtgcagtggcacaatcttggctcactacaacctctgc

SEQ ID NO: 137045 - DNA, 1615 bp, Homo sapiens
aggtcaaggctgcagtgagctgtgattgtgccactacactccagcctgggtgacagagtgagaccttgccttaaaaaaaaaaaaataataataatacttaagattattttaattgtaactctttcctcattaaaaaaaaaaagtataatgtgttgacgtttcaaaaatggtttagattcaggtagtttcaatccttttaaattcttaagtgtatttatggtgttttaaaagcagccaggcaaaggcattgccgaatacccgcaaacaggaagaatttccttctgatttacgacacatctttctggaaaggatatcaagtttaatgatgcatacacttttagggatttgttgggaacaggtcagaagaatagtaatattatacattagatactatgtctctttatacataatgtaaagtaagaaaacactctaataactaagtcggtggtggtgatggtagtggtgcagtagagaaacatcttttcttgatattgtctggattactgcaacaaattcttttactgatctgtgtcagaagtaccaggggtgatctgctatagttacatagtttgccacctctttaggatgtctgaataacaagctgttaaaaatgtaggaagttagtgggatgagagtttgatgtggggttggagtagagtgggctttgtgttggggaacagggaaagaaaaaatatggatgtgtaggctgggactggagccaagtactcactgttataggcagtaggaaataattggaagtttaagagctgggaagcatgacaataaatagcattgctggaagagtgggttttgtttgtttagggtatgagttgggctgtagaaacagaccagtcaaggagcaacaagtggcagtaacggtgtagtacgggcattcattggaatttgcggaaataataggtaaaaagaaaaaggggaatggttatgggagaagtgttagggaagacttagcagtaatcaattagatgtgtaggcataaagaaatgatttgactaggtgctgttaatgaaaaggaaagttaaagagagaatttttgaacagtgccagaaacttaatttttacttggtgaatttaagatgatgttgggatgtccaagtggaaaaagtctgataagttgtttagagttaaaagatttcttcttccttctttgtctttcttcttattccctccccacccctgcttctcttgtgtaaacagaagtttatagtgcacaaaagtgactcttgggaaagtatctttagttaaggatcaagatagtaaggtagaaccaaggaagaaagaggagtgaggaaggcagatgggttagaaaagaggatccaggagaaaaaaaagatatacaggagaataaaggagacaggaaccagtttgtcttcactttggatacctagcagccaataaaagtgaccaggatggagtaggtgctcattgatgagtgactggtataatactaagtatttttaattatccacaggtattatctagtttagtaccttaaaaaaaaactagtgcaaaatatacataacatgcaatttaccattgtaaccttttcagatgtactgttcagtagtgttagtctccagaactcttttcatcttgt

SEQ ID NO: 137046 - DNA, 1819 bp, Homo sapiens
aggataggtaaatgttaggatataaatttttaaactctatattaaaggctctgtatttcacaggagaggaaaaatgaaggcattcgaagtgagtactctgtcccacatcacattttcttatctcaacaaagttcttgaaatggtagtgaaagttttttattgtgatagaaactaaccaagtttctttctttgtggataccaaacttgcaagtgttcctgggagtatatcagagatttgagaattcacacacatttcttactttaatgactctgggacacattattaacagagcaatgttacggagcacttaattgttaatgggagaaattttgacaaaattattgggaaccttgagagaattagagctttgttattacccgtgaagataaagaaacaattaagtacctattgtgtcctgaacactgagataaagccttagagaagttttctagttttaatccttttatcagctctttgagtgttactaaaatagaaaggataaattccccaggatctcctgtagcaaatgacaactggaatttgtcatcaagccctagaactgggttctttccgttgttcattttctcctgcagttgtcctgtgttataaaaacgaatttatattgttaaaatagtgttatttttttctttgggagaggaaatgtgagagtgagagcatgtgcatgaattggagttaggaagtaagatcagaagcagttggtgtgtgaagtatatcatgtggagaagacaatggaaaggcagtatatggtagtttaaaactggtagaggtctggcaaaaagtcagtaaaagcagttcagtgtaaattgtaggtatttttattactctagagattctgtgagatctcacataattcaataaagttcttctcacctgtgggaaagatgcatattatttatatttgagagcagttttgtttatatcaacagggaccacagtaataatttagactttcaacttatgaataaaattatcaaagtgctcctatattatcttatttggcaagtattgtttccatgtatagatgggaaaagcacttatgccataactagtggctcttttaataaatacatagggaagctgttccttctatagaatgttgtattgaatatgtctaagatagaagtgaaattttcaatattgacttcttaggtgatcgaatggaggctatatgcattatcttggggaggaaatgtattttagggctttattttttgcttacatatttgtatttttttatttctaggctgttcgctgctatgaatctctaatcttaaaagctgaaggaaaagtggagtctgatttcttttgtcaattaggtcacttcaacctcttattggaagattatccaaaaggtaatttttttcttgttcattattgtttgatttatacatgtgttggattgtaattatttgtgctttatcaagaggattttcctaagaaattgtaagtgcatgagcaaactaaacaatgaggaagaaaagtagagtagatggaaatggaaatcatcaataagttggctattcagtaaaagtgaaaaccacctgcatgttcagtgcagttttgttctgccttgtgaaaatccttgctcttgaaaggccttcccatagtagaaagtgacccagtttgatatagatatttgtacattgatggatactttggaaaggtaacaaaaactcaccatttttctttatcctatttaaaacgtttccattttagctcaaaaatatttgaatgaaaatctgatcgttaagtagccatgttattgtaaacaagtaatacagagagatgatcacagat

SEQ ID NO: 137047 - DNA, 1007 bp, Homo sapiens
atttgccctttttatggtaccaagctgccaactcagaccattactcaggaagttaaaagcacccggaaaccccgcccttccaataccaaagaaaaaatccacattaaaagaaaattattattatgaccaagaacattttaaccttttgatgatagtaaacattttgatgtggagtggatggatgtgttatgcttgttttcaacaagtgtgtttagagggcaaaacacctggcagatagtttcagggctaaagtgaaggattgttagtatttcatattgatgttttattatgcgacttttatgttaggtcaagtgaatgttttcctaatgaaaatgcaattttagtctgagacaggcatattctgtgaggtttgaaattaggcttatttctcagcttagctctgttatatacagctgcactacctttaacagattatatataaacatcgctgagtatctgttgtctgatctgtaaaaggggaggaggtgagggatgacgcctcatggattttcagattgtgtgacactggttagtacttagcaaaatggtttcagtccaacagggtaatgggtgttaatagttacttaatactccgttagatattttatttttaattaaaactggaaacttatttaaaggaaactattgtaccaaaaaatagatagaggcatacctgggagatattgcaggtttgatttcagacccctgcaatttattgcgaatattgtaataaaaccaatcaaacaaaatttttttgtttcctattacatataaaagttatgtttgcactgtaagtgtgcagtagcattatgtctaaaaaatgtacatactttagttaaaaaaaactttcttgctaaaaagtgctaacaatcaactgagctttcatcaagttctaatctttttgctgatggagggtcttggcatcgttgttgatatgtgctgagtgatcagggtggtggttgctgcaggttggggtggctgtggcagtttgttaaaataagaaaaca

SEQ ID NO: 137048 - DNA, 1043 bp, Homo sapiens
agtcatcttttctgtgtaaagttttctgagcttggcatttctcttgagtttagttcctttaaaaaaaacaaacaaaaaaaggcttctatttctatagtagaaaatggtagaacctgttttgtgtgtgttttgggctgtggtttttcttacccttaattgtcattttgctctcatctactttctgtcttacaagaattccaagaaacaattttggtctgaagatggtataatttggtaatcatttatcttttctgtgattccagatgaatttgatgcagaaggaaaaaaggctttgtaaaatattttcttagcttttctggctggtgatatgaatgaagagtttaaaaaaatgtcatgtcactttatttggtcattttacttgtaggaatttattttaagtcttaaaatagtaattggataggggattgtgggaaaatggaggctcactgcagtcagtctattgttgtaggttatgttcctcagtaaggagtttcctttatgttcaacagctttggaaggtggagggtagaaccagtattggacagaaggagaagttaagctgtgacagcctttactaacttcatgggatgctctggagccagaatggcccttgagagctataccaagttgggccaagatagccaggcctttatactccaattattccatattgaacatgggccagcctgagaagaactgtgaccagggacaagttggctctctgcaactgaggcagcttctgtagaatctcacagatagaggctttcagcaagcaggattcccagcagttctttcttgaagtgggatatgagtgcttctttacagtgtctactatacctcctttttactcctaactctaaagctaacccatgaacctccgaagccaaattgctgatggggctctcagatagcttataagccttaaaccatggagattatgcagtgatttcacttctttgggttggaggacaccctgagagatacataaccctgggctgaagcccaagcatatgtatttagatgaatatatgtgatggatctta

SEQ ID NO: 137049 - DNA, 1053 bp, Homo sapiens
cagagagagtgggttattcagaagtaaatcaaatcaggccggtcatggtggctcacacctgtaatcccacactttgggatgccaaggcaggtggatcacttgaggtcgggagttcgagaccagcctggccaaaatggtgaaaccccgcctctactaaaaatacaaaaattagctgggcatggtggcacgcgcctgtaatcccagctactcaggaggctgaggcaggagaatcacttgaacctgggaggcggagattgcagtgagccaagatcaccccactgcattccagcctgggcaacagagtgagaccccatctcaaaaaaaaaaaagtaaatcaaagcagaacacttaacacttctgggagccttcacatcatctattttgtagaatatagaggggagaatagaaactttatcagaacatggtcaaaaaaaagccaagcccagttaagaatctgggccaggtttatctgggtatttggtcctcaggttgagaagaggttacaagagcagcagaattttaatgataagcctcagtgacttggatctggggcatagctgctgtcctgggatcaccctttttcttcatcttgggtattcccatggcctcttgtctctgttgtgtctcctgctttcaataaaccatatcttcttctttcttgtatatactctcctttaaggggagcatatttgtcagatttttcttcaggaaagttatttgggagataattttctttggagactttgcgtatcagaaaatacctttattctagcctcctaatagatcgcttgactggatatataattttaggttggaaataattttccttcagaattttgaaaacattgttctgttgccttatttctagaattacatatctgttgtaggacccttcaaactaccaagtcatagccttcttttctgggaatatttttggaattatttcctgaattttcttttttccttttattctttctttttggggctctattattgatatgttagacctccggggcacagtttttctaattttctgtttttgtcctttttgtt

SEQ ID NO: 137050 - DNA, 1043 bp, Homo sapiens
aaattaaaaaaatccttttctagctgatcagaaaaatattatgcccccatgttttcatctagtagtcttatgggcttctttttatatctaactctcttaatcctccacgagttttgatctttgaggaaggtcgagttgatctaaggggttagcctagatgctgttcaagtgcagatctgagatttgaccatggttttacgtttctgaactgaggggggcccagaattttaagttgtttggtctgaaatatcactatctactgggaggtgggtgtggtgggaatcttgttaccgtgtttgttaagtgtattattgactttaaagtgagacataattatgactcataattattttcctttcagcattatctgcataccagaggtactacagtttacagtctgactactggaaggttagtgtacatttgcatgctgatttcatgtttgtgttttgggcagattattgccaattatactcaaaattaattgagctcttgcttttttttgttaattacttaaaatattgcttctaggggaaaggtattggaaaagggttgagagtatttatgtttgtgctgtcttgtatgactctccttgtattttattaagaattagagtcctctgacacattttactggtcaaatgtaatagaagtgtgataagtaaaaatcaagcaaaactaaacaaataacaataacaaaatgattccttggttttcttttctaaagttggtacctgggagtaaaagaaggctgaagacgtgtatatcaggctaaaatgggaaggtgtaatgggaaagttatgataaactctttcttggtgtactctgtttataattggagctttgaggagagctgaacctattttttagaagacctacctaaatgaaagactgtgcatagcagtgaaacaattaatcatccactttcttatcttaatttaagcagtgattaagcatgatcttttacatcatgtttacttttaagtttattgagcagtgagtttttttttttaaatctgaattgctgtttcagattttttgtgg

SEQ ID NO: 137051 - DNA, 1057 bp, Homo sapiens
caaacaagggcaatgttttgagagttttcatgggaaatgatacagtcttgatttggctccttccagcttctttttatttcctattttaaaaaatctttaaagtaaaatctttaaagggcacccacttttttcttcagtaaataatgtaaaaaagactgcattgacatggctacatcccccaggacccctcagttgtttagggctggactaaatggctggtgtcattgcttacaaacgtgtcttgaacttgatggagcttatgttgagaaataatgtttatatttttatcttttaattctgtttttttccatgaactttttgaagtccccttgtactgggtgattggattagtaaatctttgggcatctactctatggaagtgcgccctgtgctaggtgataacaaggaatacaggcagtgatcactcctgcctttatggcatttttatttgatcggatggagtttagtcaacacacaagtaacaaatatatggtgtaatagttaagagtgagctctggagactgacctagtttcagttcctatgtctgctagttagtacctgtttccttgagtaaattgcttattctctgatgcagtttcttcattctataaatgaagccctctaccaccacataaggttttttagaaccttttgaaagagttgatgttagatattgcataaaactaagtttttactgttacataataatgtcagatgatagagacgttgcagtaagaccaaatttagaggttggaaaaatcacctctagtttgaggtgggacaagaagcaaagctttcatggggaaggtggcatttaaatggatcttgaatgattaatagaatttatagggtggtggggattgaataagatttcctagagggagaagaatgaagttgggagaatgtacagtgtgtcctgaaatcagaaatgcccgtctctactaaaaatacaaaaaattagctgggcgtggtggcgggcgcctgtagtcccagctgttcaggaggctgaggcaggagaatggcgtgaacccgggaggtggagcttgcagtgagccg

SEQ ID NO: 137052 - DNA, 1025 bp, Homo sapiens
atcactgttattttggtgttttaaaaatatattgtaatgcatgatagaattttaggacttaaaacatcttggataccgtattttacaataataacatcatatatgttagatacaagtatttttcctaaaaatctttttcccttcctttacagaatgctgcctttttatatggtcttggtttggtctacttccattataatgcatttcagtggtaagttgacataaaaccagtaattcagtcattttcagtaaatggcttgtttgcttgttttgtttgtgcttgattttttgtgtgtgtgtgtaataaatagaaaatttagtgtcattaaacctacacttttcagtaatcttttgaaatgattagattgttccttgaagggtgttggctcaccttagatttttagagttgtatgttttcctgaaagaatctagtataagattctgttgaagaaggcttagattagaaagctttttggaatttcttagtcattcattatggactggtgttccccaagttatttgaactggtgaatcactgtgatctcagaagtcaagatatgtgggtaaatggtctatgatggctagttttcagacttctagacaagattgaccacttctcccttccacataccagctagcactttccaatatccagtaactaggcaccaactcataaactctcagttctctgtagaatagtaccacttcagagttggagattaaatataataatagtaatatataagattttctaaactgtaaagtgaagtaccctgtaatattatggcctttgccccattgttgtttttctgtttaccagacaatagtatgcactaatggggtaaaaaggcatatagttttagttgaaagattggtattgttgtcacagcattgccacttagtttgatcttgaattaaataacttctctaggtctgtttcctctttagtttgtttatttatttatttatttattttatttatttatttattttttgagacagggtctcactctgttgcccaggct

SEQ ID NO: 137053 - DNA, 1074 bp, Homo sapiens
aaatctcttgttcagcctgttagcctcagagaacttaaagttttattgattttattttatgtatgtatgtatgtatgtatgtatgtatgtatgtatgtatgtatttgtttatttatttatttgagacagagtctcactctgtcgccaggctggagtgcagtggcacaatcaaggctcactgcaacctctgcctcctggattcaagctattcttccgcctcagcctcctgagtagctgggactacaggcgcgtgccaccacgcccagctaatttttgtatttttagtagagatggggttttaccatgttggccaggatggtctctatttcttgacctcatgatccacccaccttggcctctcaaagtgctgggattacaggtatgagccaccatgcccagccaacttaaagttttattatgtgtctttccaaatgtactggaactgtgctaagaatattaatactattatttttactatagttttagaggaggctttaaaaatgactttgtggaagtcttattaaaaatgaccattgtgaaatatattcagcacatgtatatgttttttgtaggtagtgttattgaggttttagctttatatcattttctttttaaaatggttaacagtggcaaacattaaatgaaaaatcctttaaactgaaaatctatagaaactattttgatgatataaaaactatatttttcagattttaagaaaaatgccaatgataccatgcagagcaatgtgcatttcttttgtttcgttagagaatatgctttaagtatttgaaaactgtaaacctttccagggaattgtatcataaaagtatttatggtttctggtagctatttctcatgttctaaaattccatcagtcagaattctgaggttacagaaattgaatgtgttaatgatttagtctagtttgtgccatagagatcatgttgtggccacctgcattttggtgaaatatgaatgcagtaagctgatgaccaaaattagaatgtagtctgagtgttacctattttctctaccctcccactccctcaactcttaactctaaactcttaactc

SEQ ID NO: 137054 - DNA, 1073 bp, Homo sapiens
ccgtgtgacattgtgaactaagtggaaaagatgtctgtgctaaaggcacccatggagtaaaacatatccacaaatactgtgtttagggaaaaggctagaaatagaaactgagagtaggaaatattgcacctgaggggctgttattgtactgtgttccttctccttctcttcctgacataccctttgttatacctttttcctttcctgaattctttgttatttctttattcttttccactttcattctttttctttcatatctttgactcaggcctgcctgggttttttattggcatgtgtggacattgcttagttctgacccattccattagagagttttctggtcctataaggtaaggttaagaagcattatccataattttattattataaaatataacatacctacagaaaaatgcataaatcgtcattgtatatcttaacatgttgttataaaataaacattcatgtaatcaccacctccatcaagaaataaaatactgctatcaccccagaagcttctaaaagtctttgtataccctttcccagtcacaccatatgttttaattggcagcatttattgctgcagttgtcctcgtcctaacccttttgatgccttttccaaacatgtgacttgccccaacccctaagtgtacattgattaagtaggaagctgcctttaaatgagaatggtaatttaccacagtttttgcctgtcagtgctttaactctcctctcctgcctcaaagcctatatacatcagataataacacacataccccacctacttaaaaatccacctaacagatggatacccagctccccttcagaagaaagtactgtcataatcagggtaaaggtgtctgatgccagacctgtgttccacccctcactgccatctgcaataaacactaccttttaggactcttaattttatagcaaaagtgtacataaccattcacacttttttgggaagtaaataatgtatgaattgatgaaagtaaagttactaaatacatgaagtattattttgctctattttgtggctatgatgtttcgaactattttataca

SEQ ID NO: 137055 - DNA, 1965 bp, Homo sapiens
ttttgttttgaaagcatctaagattctaaatagccactttaaggtctgtaggggtagagataattgattaaaagttttgcaaataatatattagcttgtgcttggaagaagctttaaatcatgtagaggaacctaaaatgatactgaatatactgttatatctgatataaccttcaaaattcaaagtagacatttttctttgtcattattttaatatttatttttgagtaggcaatacagtcatatgatcaaattaaacaatataataatgtattcaatgaaaagtgtttctttccccaacccctgaacttgttctattggtgatcaaaaccttttataaaagatacaatgtgaatttggggcaaagatgaactgatagacgaagaaaagcggaatggaatagagaagtagacctacacaaatatgggtatttgatttaggacacagtagcaacatagagttttggagtaaggatggtcatttctacaaatggtgcaggtactattggatatcagtttggaaaatatgaagaccgtctcttaaccgcacatagtataaaagataaggtacagatggtttgtaagcctaaatatgaaagacaaaaatgtaaacttttagaaagaagacttatttttatagagtagaccagaaacaagattaatcccatatccttaaaaactttcctgtttgccccaccctgttttcctctaggaaatttcagaaacaatgaaatcagttatttctactgataatttgattaaaccatgaaatactgtctgtttgaataatttagaataaattcaacctatcttccttcccctttatatcaaattagattatatacgtttaattatataaaaggtccatatgccccttttcaattttacttttttagtatttattaacatcatttttataaaaccaacatttcctttaaaacaatattgcataaaacagaagtttcaatgtactaccaagcaagaattcatgcacgtgttaaaaagttaagatatcttatgtctatattctttcagggcaattaaagcatttcaggaggtgctttatgttgatcccagcttttgtcgagccaaggaaattcatttacgacttgggcttatgttcaaagtgaacacagactatgagtctagtttaaaggtaggttgttgggttttttcaagatacaatgtttaattttgtggtttttttgtttttgtttttcttaaatattagagcattgagaaatgttggaatttatattggcactttaaaagaaaatttgaaaattcaggtgacagaactgtttatcaactgtgaagtagagtttcaaggtacaaagtagttatgctaagacttccatggtaacattatacaattacactttaaaaaaatagttttaactaagatctgtcatcaggaaagggtgaaggtttcagtctgtttggatatgtaaataactcctctagaaatgatttgccactgtagagttcagaaccagctgaatggttctgaaaggatgtttttctgtgacccaatcattgaccctgtttccatgggtctcagtacttctaccagcagaagcacatcttatatttaaattagaaaaaagagtgttctctgcaaggcatttggactgttggtttgtgagcataaacgttgtgggaaaagatgatatgttgttgattaacttcgtatccatggaaatgtgatatttctccagtttttaatttttcattgagttttttatgctatctgaaccatcaatttaggtcttgctgggctttttctgaaaatagtgctttcctgcccaacagaggaattatgttttgaaaggagtagcagttgtaggaaaaagtttaagtttttgtgaatttatgtttattgtttataatggttgttgtattctgaatctccattgcagactatcttgattctaaaggaagggtggttggggagataaagaatgac

SEQ ID NO: 137056 - DNA, 1099 bp, Homo sapiens
catgaacatttttagtcaaagaggaggaggtattttagtttattactaaagtgcttagcattcagaatgagtgaaggtaggaatagaaggaatgatatccccctttaggtggttttccatttttctaatacttcaccttcatctggataaatgtggaacctctgatggcttttccacaacattaagctgttttgtagcacagtgtgttggtatagatgctttttaggctgtaacctcagggactccaactcaaattggttaaaataataaaaaatatgctcctatgtgaagtctagccttcaggattggttgattcagctgatctaaggtttcatcaaggattcattttcttctcagttctgtattggctttttctaaaggctggttgctctgcttagtgtaatgctggcatataagtgcatagtaaatgatgatgatcatttcatgtaggagaaagatcctggttgcctgttgatctcttcaaaaatacttcaccttgcatcttattggccagaaataggccacatggccattcctaattgatttcttatcaaaggaaatgtggttgctcttagactagttatgcccagtctttgagaattgttcaaatctgtaagtagttgttatccagtggagggatagggtgggtaaaaaggatattttggtatggggagtggtgtgaacagtctgtccgttacagatcagatcttctctatcccatttcctttccctctgcccaagtgtgtataatactttttggatggtaaactatttaaataaaatacagcgtattttcataatagattccttttttttcctcccaatatgaaatgaattgtagggcctcctgttgtgtttctgtcactggtgataactttctcacaaaatgtgtctctgaaattctgtgttggtgctgtgtaaacagctctcagagcaaaccaacttggttttcaaaactttgaccctgccgcatatcttcgtgaccttgagtaagatttctgactcttgattttctctgtgtctgaagaactagaataattatagccacccacatgattgatataaaggtgaatatatgtgtgtgtttgtttttatatgt

SEQ ID NO: 137057 - DNA, 1027 bp, Homo sapiens
aatgcttcactgaggcagttcttaatacatactatttttggataaaccaccaggcagataccaaaaaatattagcacactattctggtcatcttaagaaaagaagaacattcttttttagtattagttacactgtgtatttcttcctttggtataactgttggttctttatacataaaattcatatagtcagattttgcttggctttttatggttagcagtagattggattatgattgaggaaactgcaacccagtttattttctttgatttaaatcttccttttcctttcagtcattgacagtagaactcagtttcacctgagtgtaacatcactgttccttttggcagaggatggtcattgctgtttattttgttttctactttttctcacttgtagaaaataatcatcctttctctgttcttttctctttgtactactcgtcagcttgtactttaccaatttcctagataatagtttctgatacgaggcaacctcctaattaatttatctggccacttaataatgctttctctatttcactctgcctgcccaactttggttttctgtttgatattatttctgccctgagttctataacgtgccttcaagtgtgaattagtaaaagtggccgaaatacttcaatacctgcaaaatgcatgtttgaaaagtacatggctgctcatatatgtgcagtaacaccattctttctctttgaaactgaggagttagggtgattctaggttccctgtgttacagtttctctcttctagtatattttaactacagaagtcatttctaaagtgatttctggtgctaacttacaacaacttaagggcgttatagatatttggtcttcaaaggcagctttataaagcagtcactgtattgtcacatttagaaaaaggttgtgtggctgggcgcagtggctcacacctgtaatcccagcactttgggaggctgaggcgggtggattgcctgaggtcaggagtttgagagttgcttggccaacatgatgaaaccctat

SEQ ID NO: 137058 - DNA, 1033 bp, Homo sapiens
gttaataggtatatctattttgcatctggtttaggtcctggaaatgaggctttgtggtcatgttatccctaccccggttcttcatctctcttgagagtgctgaacggcatatcagtgtttttctttatgtggaacggtgttgttagtttcttataaacacttagtaattattctgtaagttctttcattgtcatagtggatgtttttgaatgtgtattcgtgttttttttgtttttgttttttgaaacgcattctcattttttctgccacaggcacccgccaccatgccggctaatttttgtatttttagtagagatggggtttcatgatgttggccaggctggtctcgaactcctaaccttaggtgatctgcccgcctcggcctcccaaagtactgggattataggcgtgagctactgtacccaaccaatgtgtattcttttgctgagtaattttcctatgtcttcactgtttggaaatgtttggtatttcatagtgttgtgggtttgaaatggtgcatcagtaacttgattgctgcgtttaagattgttttataattacacaaaacatggtcaagaaatactcctgccaggtttcactgcagaatcttaaattactgatagatgaaatgtaggctaggctgtttgaattctacatctctattcttccttgtggggtttcagtgaaatagtaaaactaaaatattgccatattgaaggccgtttcttctcatttcagtttgtaccctttgatggctcagttaggaatggtggtctgtgttcttctatctaaatatttatgcttacaggacaaattagacttagaaatatagtacagtctgaatgtgtgactactcttgtgctctttttgtctagaggaaagcaattgattataaagcatgctttgctttcatagtactcaaacgttttaaaatagtctgttctctattgctatggtagcacactaaagggatgtttgaagacacagtctgcttagtaggccaagggaaaataaaagcagttttcaaagtgtt

SEQ ID NO: 137059 - DNA, 1161 bp, Homo sapiens
ctttttcacataaataaaaatatacataggataacttgataaaattaattctttttcaaattctccattctcagctgtctcaagaaaataacccccacagcatgtcagttgtcagcagtaaatgttcaaagtatttctagttggtaggctagtgtattttatttgcatagcatgtatttattattattttagaccttacatacctgaaaagtatcttaagatgcttttgtgtgactctaaattgactgcattaattttctcactctcgtcttgcagcattttcagttagctttggttgactgtaatccctgcactttgtccaatgctgaaagtaagtattattaagtactgtagttttctacatgtattccgatcacttcatggcaaataacaataatgttagtgataaattctgtgcaattttttcttttagaattgtttaatgtaactgtattggttgccatggctacttacataaatggaacctgcaagaccagatattgtgaacagcctgtgtctaaaatagataggccagtgaagtgagttgttgaattaaaagtatcttcactaataaacaagattgatttttctctgtcgtgtattatattgtagatgacttggtaggattaaaaacaggttttgctggtcttttaggaaacatgagtatataaagattcttatctgatagcttactgattcctactgcgtgggataaaaattattggtaattatgaagacatttgtgacttttatgatagttttatatatcatttagaaagcttgagttgacatttttcaattaattagaaaggaatacatttacgaagcatgttctaacaaagtatttttttccaaacaattattttctgcttctatgtaggtgtcttttcaaaagcagattgggttgattatatgtttatcgatatgtatttaggtatatttatttaatatacactaaagtatccagtaaaaaggtttaagaatattcgttgatgctaaatttcttaaaaaccttcttacttgaaaaataaattattattattattattattttcttttttttgagatggagtctcactctgttgcccaggctggagtgcagtggcgcgattttggctcactgcaagctccgcctaccgggttgacgccattctcctgcct

SEQ ID NO: 137060 - DNA, 1059 bp, Homo sapiens
tcatgagtgctacaaggtggttggtcactcaaacgggagagcatattttctatttagagactttaggctattacagtttagtagatttggatagtttactttagacagtctacttgattacttgatagctataataatgcctgatgtcacaacaaatgtagagtacctactttgagccagtattactcttttcaacaccaggctccttattgtctttgtaaaacttatttttctttgaatttttacatcatcactgatttgtactttggttttaatattttttaattaaatattgattttactcttttttgacttgggattcagtttttaaatactgtgttttgaaatgtatagattataaaggttttctctctttgcttaatgttgccattttgaactttgtaaaacatatattcacttgctatagatttaatgctaattttaataattgcattgacagaaatttcatttgataatgaccaacaatgaatacatgtggtttcttatcatgattgtgttctttagtgtgtttgtttgtatattctattttagtaaaagcaaataaaagttatgtttttctattacttaaatctatatagtgtagactgtgataatgtttgatgctttgttattcttacttaatttgccccaaattctgctgtattgttactgatttttttgtctttcctcatcctttgcagttcaatttcacattgcccacttatatgaaacccaggtaagtattttaacttattctatttaaaacaaaagcaaacaaaaatcattactcctatcatgctttactgaaatcagaagtgtacagataatttaatggagttctgggcgttacttcttaggtaaattttgtattttatactcattaaatgtgatcaagatgctgcttagtaaaacaattattccaaggagtgcttgctgtgtacaaattaattccatttaatattttcctttaaacttgatccatttgcggctgggcgcggtagctcacacctgtaatcccactggtttgggaggccaaggcgggtagatcacttgaggcca

SEQ ID NO: 137061 - DNA, 1091 bp, Homo sapiens
tcagtgtgctattctgcttgttagaaaagcaaactttagggtaatctttggctggatttaaaattctctactgttttgtgtctgtgctttcttgtatatacattaggttttgctcatgctgttcaaacccatttaaaacgccttttctcatcttctctgcccgaatcagtggttcctagaattttaggttacataaatcagtaaaatttcaaagaataattatgaggatagaaatatggtgtttgggcaagtaaaaacattaactttttttgcaatttactgtcagccaataatatccaaaataagagaattacagcataaatattaattcatttattggaaaaactttatgtatgtatatgtgtgtgttgtctttccaatttgtttgcttggcaaacgtgccatatactggctggcaattaggaatcactaaataatatgcatctttacatattcaaatcccttactcttactctcccccccccccctttttttttttgcctttcctaaatcttgcagaatatgatggtctcttcttatcctaaattctcaggccaattattgtctatactggccatttgatatgacatcatgacatttttaatgtatcttcagtcctcaactaaattgtaagcttcatgaaaatagggactgggtttttgttttttttctttttcctttagtgccaagaataagaagataatttcagtatttataatttcaactgttatctgtgtatccatcatgtccatcgtgtatattcacattaagaaaattacagtccttgaatcgttaatcttaccttgctaactttactagtcataaaatattatactttatattatttttactttttactttatactatttttgatacttagtttgagattaactatgtcttacatgtgcattttttttatgaattaaagaattattgccctcagtgttgttacttgggaaaggaaaattgaaatctgatacagcaaatcttaccaacgtatatagtgtttttgtttttaactctgtattttgaccatataggaaactagaggtcaagctgtataagaagagtggaagagtgccgtgtgtgt

SEQ ID NO: 137062 - DNA, 3265 bp, Homo sapiens
acaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggtaaaatttttaaatggcagttttttaaagccacatatttccccagaacactcaggcagaaggagggtggctggaaagtttgtctagttgtgttttgatgtctataatctgtttccatattttgtaaacataccatagcttgtaatattattttacttttcattttaagtaagatatgcagtatttttaaagatgctcttttgcacatttactctgttgatgcatattaatttacataatttttttctatgtactgtctacatttttaagttgtcatagcattttatagaaaacacaaacagtctttcactcttgcttggagtttcttgagaagacagctatgagaactctgaaaacagagctcagctttgttttgattctcacaaaggtttatattccggttaccctgtttatacttagtgtcttctaaagccccaaatttagaatctattttcttttaaaaacaattagctatagcatttaggaagatttagtggacttgctcttactcaagtaggcttgtgttaaatttgctttttacataatttttcctaggctcagttgtgtaaccttccacaaggtagtctacagaataaaactaaattacttcctagtattgaggaggcgtggagcctaccaattcccgcagagcttacctccaggcagggtgccatgaacacagcacagcaggtgagaagttgggttatgttctgcaggtgcccagctttaagggttcttttcaattctctagtggtcaagcttaatttactaagcacaggaggcttttagtaatgaaaagccttttgatttaattgcaaagggaatctagatcaaaataaaattccctctaatatgggaagagattttggggtaccaacttagaacctttgtgcattttcatgattttgaaggagatttcttaaaataatgctacagtggtttgtttaatttttaaggcaagtttttcaaaggaaggtacacattattccattgatgaatcatttaattttgattttcaatcattgcaatcagcgatgtccacatagctttgaaaagtatgcagcttgtaaagttttataatttgaaggaatgaattaagaatatatagaaccctatttttgtcttccttctgtgattcttaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaaggtatatgttttagagaaatagaaaatcccagtcaaaaaagaagtttcagctgccctgaaattgtgcagtttgaacatttcctgtcctttattttaaatttgtggacatcaaagagtgaaaggtttgagtttttccatcccaaacccttagtatcatattaaatatagaaagtagggataaatttgcattcatcaaatcattttattcatctccctgccgttaagatcccagcacacttttcatcatcactttttactgacattgaaataaatttaatgttggatctagtggacagtgtggtgtttaggctagccgtttgggccatagtttgagggtgggcctttttgggtggcttattaaatagtcagtaatttttaaatgtatgatttctaagtttaatatgcatgtaaaattattttttaaagaatttaatgttataacatctttttaacatgtaaatattccaattcatagtcatttggcctcctctaaccattattattaactgtggatttaaccaaatattctttaattttttttttaaatcgattttcctcagaatacttctgacaattggagtggtggacatgctgtgtcacatcctccagtacagcaacaagctcattcatggtgtttgacaccacagaaattacaggtatgtaagatgtttttgacaaattgtttattaaaaaggagtagaggtagcaaacaagtattaattttttttttttttttttttttttttgagatagagtcttgctctgtcacccaggctggagtatagtggcacgctcttggctcactgcaacctccgcgtcctgtgttaaagttattcttgtgcctcagcctccagagtagctgggattacaggcacgcaccatcacaccccgctaatttttatatttttggtagagactgggtttcgccatgttggccagactggtcttgcactcctgacctcaagtgatccacctacctcagcctcccaaagtgctgagattacaggtgtgagccactgcacccagccctaagtattaattcttataagttaaatggcagtacattcaattaaaatgcacaaaagtaaaatgagcctgcatttaccagaataatgaagagcattcattcttgtttttaatttctttttttttttttaaacaggacatggtttacactacataaagtataaatatagggtatatagggtaaagttttcttctaactctggcccctacccactcaaaatgtggctggtattactaatttcctatctatcattccagaggtatgttatgtatgtacaagcaaatatacatccccccctttctcacatgtattattatttttcttcttttttacacaaatgataggattcttatttgctgttaacaacatattttacagacttctgcatgtcaatatgtgaagagcttccttgttcttttatggttacatcatatttctttatatagatgtaacacctttatttaagcagatcagtaattttggacattcaggttgtcttcagactttgcttattccagacagtgctgcttttagcatacttgtcaatatatttttaagcttcaagagttttctctgtgaatacctaagaatactgtatggatgagtaaaatttcatgcccatctattacaaagaactcatagtaaatcttgttcagatgaatgcttagttcattcttatatttctcaagcttattaaaggacttcatcttggagtgtgtgactgttggtcagaagacagtgtgtttgaccagatagtggt

SEQ ID NO: 137063 - DNA, 1035 bp, Homo sapiens
taatgggattttttttttttgaaaccgacttttgctttttcaaggaagtttattttaaaatgaacaaatacaatttcttgtttttaaagtatgtatttctcaacttagagaaattaagcatttgggtaaaatcacacattccctaattatacatcttcatattcatctggggattcatagagaatcccctatagattctcttccctatagattacacaaccagcatttacttttcctttgtttttttgacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggtaataggaggactagcttccttgttggcttttcacataaatgtttttactgggttttatacactttgagagaagaagagagaagtgtttggggaactggttttataagaattttgtggcactacaatgttactacattgtgattcattatgtacatacatgagtatatctttgttccctttgtacagtctctaccgacatagataacttagcaaatttacaaaggaagaaaatagatcatataaatcacccaaaatgcaccattaatttacagtggcatcataagcacatttatgtaatattacttagttcatttctgcataaactgcctacttaagatcaggcactaaactaggtgttaggtatttgctttagtgggagaaaaag

SEQ ID NO: 137064 - DNA, 1014 bp, Homo sapiens
aagtagcaagtatagacagttccagcacacatgcttacagttgtttgggctacacactgcacagtgccaaggcttccatttccatataccgtggcataaaagagaacaacaaccgggtgtagctgacagggaaaatgggattaggagttgttgtcttgttgttgttttaaatttaaaatgagagaaataacagtaaaagtcaatgggaaagattcagtagagagggagaaaatggcaaaggagaaaggggaattgttagaatgggtgagaggatgggattttgggggttcattgtctttaagcattaaacagttgttaaaaggataacacgagatttttgttaaaatgcctatcatagttctaaggtataactggcagttaataagtgaaagcctttgttatgattgtaaagcatagttctattttcttttctctcacatctacttctttggctcacttagttgctgaagttttcaatactctcttaaccctgttttggaaatgtgggattctttaaaaacgtaattcgtaattctaataaaaaggaactcctcagttggcaggccacgaggcttctgtaatttaccatactaagtagcagggagcccccagcctttgcttcacacgcccttcaaagccattatctgtaggaactttacaatttaagtaatgaggttgagagagttgtttagaaaatgatgttgaactgattccaggtcaaaagtttcccaaatgaagtttctgcatatcactacagctgggaagcctctgtctctgctgttgatatatggtattaatatcatagactctaaagaggcctttttggtaacttgtcttatacaaacctatttgaataatttttgaaattgtaatgaaaactagacaactggtagacctatatggtatatctaccttttagtttttgatcaagggaggaatttacattacagtgtggaatgggtttattcagattgcttttggtagcaagggtataatttaagatatgaaagtaaa

SEQ ID NO: 137065 - DNA, 1066 bp, Homo sapiens
tgcctgccttggcctcccaatgtgctgggattccaggtgtgagccactgcgcctggccaatgtgtatcaacttttaatatatctagtgttttaggtagataagcctattgagtaaaaacattagtttaaaattttcagcttcagaaactgattttaggggcatgctagctgactttaactagatgattaaatgcaccttttagtatataaatatcttgttatcagctatagttttattcttttatagcttattactgacaaaatgctctaaccttgttgctgaagtaatctcaactccaaatgtaaactcgttttatgattccaatgttactttaatcagtgttgctgaaaaattggctgtcctatttaattattttgtaagtaaaatgaaatgaaaatattcttcttaaagaagtttctctgtgacaccagaggcaaatttcaggtaaaaattagttccagttatcatattttcattctattaaatgccctaagtgatcttcctctagtcttaaaacttctattaactgttagtatactgccccctcagattgctttaacagtagcagtgtatttttctaagttttcaaattcaggtgatgaaaaataaagtttatctcaaagtcattagtggagacttaaaatgtctttttctcccctttttttttaaaaaaaaaaaaaaaaaagagagacacaaggttctgctctgtcacccaggctggagtacagtggcaccatcttagctcactgctggctcaaactcctgggctcaagagatcctcccaccttggcctcctgtgtagctggactacaggcacacttgtcaacacacctagcttgtctgcctgctttccttccctctctcccctctctccctcctctctcctctctcttctttctctttctctttctctttctctttctctttctctttccctttccctttccctttccctttccctttctctctctctttttcttttgtggagacggagtctcattgtgttgcccagcctggtctcgaactcctggcctcaaacgatcctcctgcctcggccttccagag

SEQ ID NO: 137066 - DNA, 1539 bp, Homo sapiens
tctttctttttaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggttagtgtgggaaagttcatcaaagtgaaaatgtttgacttactggcatgatcagaatgctgaaatttggaccgtttaagatatgggaagtaagcaaaagatggtgtagtcattcatctaagagtttgacagaagctttattttgcttagatgttgtagtcaaatcagatgtgagaagtattcctgtaaattgcttattttgagtgggtgtgtctgattgtgctgttactgccctctactggttactaggttgtcagcttcagtgtgattgacttcgctctggggatttaaacaagagaatgggttaaatcatatttggccaaatacagcaaggctggaaaaccctatgggttttttttttttttttatcagagcctattaaatgttaggctaggaatggaccccatcacttatcaaggctagtctttgcttacaattgagaaaactggactgtttgaatctagaagaggttataaagcaggcagaagaggaaggaagaggtcaggggcaatgggcagtggagagacatgacagactgtcagccattctggaaggagccagacatattctgctagtctaggaagggcagggcctcagaaatttatgaagaaatgaacctcctctgtcccacaaaagaagaatcaaaggatcaggcagcatcatctttctctgatatttggaggacatatagattcttactggccttttcattgtatatgacacatatataatttttctcatttactt

SEQ ID NO: 137067 - DNA, 1496 bp, Homo sapiens
gaaatttagttaacataactggaacaaacaaataattctgtaatattttctgatacattaaatgttaagtttgagcagacatatagtagattttaaaaagatctttttttggttgtagattgtcatgatatatagaaaataaccattctataaatagaaattataaacattagttctagtttggctacattgaccatttaatatagcttttacattttaaagttcaaaacaattcttatttatagccatataaacctcttcctgcagttgctagtacttatatgtcttatttattgttatgtaaaagtgtgattatcttttctgttgttcagattattttattagaaggtatcctgggtctaccgttaaatgtttgtcactgacgaatgattgaggtgaaattaaattttatttatatataagtttgctgcttgggagggatgtggggtaggagcaatggagtatggagaagaaatttcaattaatttaaatttatcgctttaattgtgacactagaactttactataaattacactatagtcatttttctttaaagagtttgagtgttaaaaataccttttggtctgtgttttcttttcttttcttgtcttttcttgtcttttcttgtcttttcttgtctttttttaagacagtttcgctcttgttgcccaggctggagtgcaatggcgcgatttcaacttaccgcacgctctgcctcccaggttcaagcgattctcctgcctcaagcctcccaagtagctgggtgggattacaggcatgcagcaccacacctggctaattttgtattttttagtagagacggggtttctccatgttggtcaggctggtcttgaactcccaacctcaagtgttccacctgcctctgcctcccaaagtgctgggattacaggcgtgagccactgtgcccagctggtctttgtttcattttctattagtttctatttctgttagtttctatttcattatttcctgtcaaattttaactatttagttgttattctgacatagactagggcagaaattacatccttttttatattttatttttttctttattgggtccacgttgttggcagcattttccttagtgacctacaacatggtgattgctgtaattaatcttaactgtcttacaagattttttaaggtcagtaacttaagaggacattggatgatctctaaatgaaattcttctaaagcatatagtgaggttcttgagttcctaaaatttgtttctttagaaatttttatattataggtttttatattagttttttttttgaagttaggctatcattcagttcaactctgggcctacagaaaatagggagtgttcagattaaatgctacacttggctctccttagacagtgccttgattcactgccagtttgactgtcttctacctgctcctcactcatctgctggggcctctgtcctgtttcctaggtactgctgctctaactgctggagca

SEQ ID NO: 137068 - DNA, 1805 bp, Homo sapiens
taggaaatttttttctgatttgagaaaaaggaaaaaatctcaggtttgagagttgttacaaagatattctgattataattgctaagatgagacacaggaaaagagacattctgttttttactattacctagaactttttttggtcaagttaatattttaacattgatggaaaagaatgtgatggtagagaggaaattgtaagctcatgtttgttgtttaggtgaaaataaattggaaaattacgagcaaaataaggaatgtcatcaataatttatatgttgtgatatcttttattttccttcagtggaggatatataggaatcaagtctttgctgaaattaataatcattcttagtgtttttcctgatggatccacatcccacatctcatggacttgtgcaaatgcctagtaatttaattaggacttaattcaggattctttttttttttttctgttttccaaataaatgtacaactgattatccctttttttttttttccaggaatctaggtaaaaatggcttatctaacagtagcattttgttggataaatgtccacctccaagaccaccatcttcaccataccctcccttgccaaaggacaagttgaatccacctacacctagtatttacgtgagtctgaattgactgactagaaataaaacagtgtttgcaactacctgtctttcataaaatctttaaatttacatggatgccctttaggaaacattacaattattggcagcagattaaatagtttgggggcgggggggaagatatattcaagaagattttgtaatagcatttttaaaggaccttctcagctattaactgtgatgatattagaatcatgagaaacattttttattgccctaattttgagcagcgttaggaaaaagctacctaaaagtgtaactttttttagtaaactgggttttaaatccacattctacttagttatgtggaccttaacattcattctgttttatacatctacccccccaaaaaagatactaccttcaaaataagtgtttgagaacataagtgtgatagtagatatatgtgactaaaaaaacttaataggttatttaaaacatttaaaactagatactagttttactttatagaaatataggaatctgatataggaagtcattagcagttcaatcaaaacaattcctatttctgtttcttccaaatagatcttcctatcctatttcctttcattttcctgcttctatcccaaattaaaattttgtaagtataaagttagggtagtatatgtataatgatcttgcatctataaaatggtactagagtttgttttatagatttaacccccttgccctctagaggccaaatattatcatattaattcttcctccaaccagttgttgtttatcccttactatgtaagggaagcactgggatagacatgtaaaaaaacttgtaaagtgagctctgaggagaaaaaaaaatgcaaaattaagtttttatcttttatgggtcctcttcagtctgctttctttgataatatttgtttaggcataattttttttcttttcctctcttatattgtgattttttaaaaacacatagcataaaatttaccatcttacccatttctgagtgtgcagttcagtactgttaagcatattcacattggtgtccaaccaatctccagaactttctcatcttgacaaactgaaactacacactgaacaactacccatttctccctcctgccagcccctggcaactaccattctactttctgtttctataaatttgactattctagatac

SEQ ID NO: 137069 - DNA, 1744 bp, Homo sapiens
taagtggaaccatacaatatttgtctttttgtgactggcttatttcacttaacataatgtcctcaagattcatccatgttgcagcatgtgtcaagattgtcttttcattttaagactgaataatatttaaaacactttgattttgaagtttaatttcagtttcatttctcctacatatttttgtcatgataaaatggaaaggagaaatgtatgtggttactatctgattaaaactagaatcaaaagtcacagtgataagatactgtcaaatagaaatatcaccccataaaatgcgttatttaaattgtgaaaaataatgaatattaatttggagcataatatttaaataaaagctctgttttcctgagatctaaccacatattttaattttacagttggaaaataaacgtgatgctttctttcctccattacatcaattttgtacaaatccgaacaaccctgttacagtaatacgtggccttgctggagctcttaagttaggtaagccttaaattaaaaaaggaaaacgtttgtctctttgttttgctatcttttaacttttccagcactggcagatacttttcttttttttcttttttctttttttttctttttttgtattttaattttacttttttttagtactaagaatgagagagagtgtgtgtatcacttctttaatccatgatgtgaatatattgttggtgatactggttactgacaatttggtggaggtttttaaatttagctattactttggtccgtttacataattgtgatttaggttaatagaaaaaatttgattataaaatgtaggtgaaatttgatgctactaataaatactatagccccataagtatttcctggcatctgcagaaattaaataaataagtgaaatttcagtcctttcacacttaattctttctcggatgggatgacatagcagttagattcagggcttcagcgtatggttctgcaaacttggcacatagctcaggttgtgcagaggccctagttttttatgggaactggatacagtgccgtaaaatgctttaccttcttcctttaaaaaaaaaaagcacttaaaatattatcccaaatataattttcattttttaactacatttatgtattcatgaagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagtaagtatttgtatcctaaagattattttaggattttaaagatgattttactttggagttttgaaaggacacattacttttatatgcatctcatcattttatgttacataaaatactttgtaagtgttctccagttgtctcgtatgtatatatgtatgtatgtatgtatgtatgtatgtatgtatgtatgtacgtacgtatgtgtattttgagacggagtctccatctgtcgcctaggctagagcgcagtggcacgatcttggctcactgcaccctctgcctcccaggttcaagcgattctcctgtctcagactcctgagtagctgggattacaggcatgtgctaccacgcccagctaacttttttgcatttttagtagaaactgggtttcaccatg

SEQ ID NO: 137070 - DNA, 3243 bp, Homo sapiens
aaacttcatcatgtggagacattactagactcattctaataactagtctagactttgccactaattaggcttgtcacttttggcaagttacatttcttctttaggtctttttcttcatttataaagtgaattacattgtttttagacttaaattttccatccagtactgaagtaccatcttctttgtgctcttttgcattgacatgaaatttcacagggtgatattcaaaatatttaacaattgccacaatcgcagcactgatcaattagaagagatactgttgatgaccagttcagctgtaccaatgtacttggggctgcaggtctccctcaggtgcttctctttgctacttgatgcagccatggtttgaaaaccagactgcttccttctttgttcacattcttactgagtcgtgcttaagaattttttcagaatagggctatgcttgcttctgggtaaaatgggtcagtggttccccatcctggctgctgatttgattctcttgtccttttttcttttttcttttttaagagacagggtcttgctatgtcactcaggctggagtgcagtgatgtgatcatagctctctgtaaccttgtttaactcctgggctcaagcaattctcctgcctcaacctcccaagtagctaggactacaagtacatgccaccatgcctggctaattgttttgaggttcacataatgacttcaagttattcttccctctggacctcccaaagtgctgggattataggcttgagccaccacacctggtagctttttaaaagtatgtaattaattaatctctaggattcagatccaggcatgagggtaggtgggtgggttggttggtttttaactgaggtccccagaggattctaatatacagccaggattagaactattggttataattgttatcctcagaccattagaagcccaattctgtgatattttatccatagtcaggtaaagtgcaaagagttctggaataaatgatagaagaactatgttctgctctgtactctgtcattggacactgatataaatgttgggcaaaaaacattattttgagtaccttgttatggggtaaacactgttcctggagattagttcataaggaaaaaaatggtaatgatatctataatagctaatatttattgcttactgtgtacagatggtccctgagttgaaatggttcaacttaccacttttggactttatggtgggtttatcagagtattaaatgcattttcaacttaaggtatttttcaacttactatgggtttatcaggatgtagtcccatctgtaagttaaggagcatctgtattaagcactgttatatgcattcattagtttatccatcttcaaaacaacccaacaatttatagagattattattatctgttcttacatatagggaaactgagtcagaatggtttaccaacttgcccaggttcaattaatgactaagccaaggagtctggctccagagcctaatctcttaaccatgattatactgcctatcatagaagctcttactgagtatgttaggagttgacacaaaaatgctacagtgatgaagaactaaatactactagagtgttctctgttgagcatttgtaaggttttgtttccaaagacccatttttctatagaattatagtgtgatgattaatttttttctgtataagtaccgtgtgctaaccaattgcaccactggagctccaattttttttcttttcacatttcaggtcatcaggaaaataacaacttctgttcagttaacataaatattggcccaggtgactgtgaatggtttgttgttcctgaaggttactggggtgttctgaatgacttctgtgaaaagtaggtttccaaagtaaattttcttaaaacatatattagaaagcagtaattgtaaacgacaacttaccaagctggatctcctaatggatacattgccagtattcacttaccattcagcgaagaattcattttaaattatttgattccaaacctcatattttgtgttattggaaatactttaagaaagatgccatgaaacaacttcatgcagtagtagtacccatgaattaagaagatagaaaagttgagttattagtttaatttttaaaatgatgcatacttattcatttgaaatgtgtgtattccaagaaaaattgttttgttataaatggttttaggaagtagaaggaattctttattgagcacccgtataggctgtgaataactcaagcttgaccataataccttttgccatatcatgatataaattctttttaaactgacaactttttctatgaagaaattttataaaatgtattatttattttttatttttaaatagagatggggtttcaccatgttgcctaggctgctcttgaactcctgagctcaggcgatccacctgcctgggcctcctacagtgctggattacaggcatgatccaccacatccagcccagattttgttttctctagttgaaagaacttggatagttcctttccttaagatcccagaaatagcttttatttacttctgtgtcttgtgttaaaaagtactttggaatttttttttagttggtttcaatttgatcatttgtctagatagaaccttactctcttcttttctagaaccttattctcttcttttctagaaagtacttcattatataaggacctggtattttcatttagtaataacattagcaaattagtataggatgaaaatatacattatatacacatttggtgttatgcccccaccccaattaaagggggaaaacacccacagaaaacatttacatgagattactttgaaaactaattatacacatattccacatactactttatttttattttttccttttttaagacggagtcttgctctgttgcccaggctgtagtgcagtggcacaatctcagcttactgcagcctccgcctcccaggttcaagcaattctcctgcctcagcctcctgagtagctgggattacaggggtgtgccaccatgccctgctaatttgtgtatttttagtagagacagggtttcaccatgttggccaggctggtctcgaactcctgacctcgtgatccacccaccttggcttcccaaagtgctgggattacaggcgtgagccaccacgcccagccccatactaacttctaatttcttactttggtttaagaatctttgctgtaaatatttggatttagt

SEQ ID NO: 137071 - DNA, 1642 bp, Homo sapiens
aggaacatttttactgtgtaagttcttccttccccaaaatatgaaatttgaagtggttaattcaattttataaagttcttttatgggaaaggttgctatgttgtttaaaaagtacttcatatcatgatggagaataagaagccagatattaaaataaaagcttaataatatctaaggaatgtttccaaagtatattggtagtagtggtcatgattatttgtgcatgtgcgtgattgtttgtttttgctgaagttgttttgaactgcatagttttaatcagctaatcatcaaactatatggagtctgacatccagtctccttttcctcagaaattaagggaagttcctggtacttgtattgccacagtgttcctgtttatggatttaaatgacttgatgtcaactccaccttccatttaccttttagggatttctaggtgctccagggagaaggcttcagtcaaaaatagtctttgttgaaatgaaattgaaagtgaatttatgtgttacttgaaagtagctttggatttcatttggatctttgaaaaatcaatttaagatggtaatgctgggccggtccacttactacaggtattataattcctgtaatcccagcactttgggaggccgaagcaggcggatctcctgaggtcaggagttcgagaccagcttggccaacctggtgaaaccccgtctgtactgaaaatacaaaattagccaggcgtggtggcaggtgcctgtaatcccagttactccagaggctgaggcaggagaattgcttgagcccaggaggcggaggttgcagtgagcctagatggagccactgcactcccgcccaggcaacagagcaagactttgtctcaaaaaaaaaaaaaaaaagtaacactgatctttagtaatttagtactcaaccataattacacactctatatacatacagcagatctttttgcacaagcaattatgtttcaataaaatgaacaagtgtttatttaaaaaatttgtgacattttcttccagtcttactaggagcttcttaatgtagttgatccatttgcattatttttttcttatttcagaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacaggtattataaagaatatgctttaaaaaagttaatttataaaggattatatccaataggactgttccttttttcttgaaatataactcactaaaagttgtaagaagaatgactccttgcatagaattgtaattcgtagtacaacaaattaaattcaagttaacaaatagaaatctaagagcatagatgttagcaaataacaagtttatggctttaatatacatgaaggttataataataaattttagagtgcttggttttattttaaaaaaacccttatgagagaaaacaaagtagaaaaattattctttcacatttaaaaaaatctagtgtttcatatgaatagctctgtaatgtcaaaatctgtttgaattatgcc

SEQ ID NO: 137072 - DNA, 1216 bp, Homo sapiens
tcaaaagcagctgtacagatgatgctgttaatgagtgtttaggtagtgttgattaaaaaaaaaataatgtgccttcctgccttactagaatcatagaagttcatatctggaattcataccccttatttcacggatgaggaaattgactcccagagaggttaactgacttgcccaaattaagagccaaaattagcaactcacatttaagcagggagtcagtttttatgtactaagaccattatattttgatatccagatattacttttctcaactttaaatgttttaatattgtcttcatcaggcctgctgagcattgtcattttaaaatctgagaatatttgataaattgatgaaagaaaaattatgaagtcatagacattagaatcaagtctcttggcattatttctagttggtatatcttttatgctaaaaatattcaatattcagttgctggtcacaaataatttctcccccacaataggtattgtcttctaagaactctgaagcaatgtcagacattgagggaagctctcattgctgcaggaaaagagattatatggcatgggcggacaaaagaagaaccagctcattactgtagcatttgtgaagtaagtaattgtttttatccacagttgttttataaagcctcttccctctccactgttggtttctctttatttttaaaaaacttttttatacttttatgtaatccagtttatagtaattaacattggattcaattttgttgcttagccattatattaaaattcagtgtgataataatgatatttcactgtgaattaaccttaaaagtatctactgcagagtcatttttgtggtagatcttcaacagacaataatcagcaaatttagtctgagattttaaactaagaacaatctagatgtacacagatgccaataaactggatgtttggtgtaactctaggcagatcgattatcagtcctctctggtgcaattaacaatacatttgtcaatcttgtgtggccaaggcttgcaagaggtgcaggaacaaagatgtggtgcctcctatgaaggagcttaaattctacttggagcagacagattataaacaactaattgtaatgtacatgagactatgatgaatgtgaagttggacttcctgttaatgataacactgagggggaaaatgacctaattttttcttctagtattggcataagaactcacaaacg

SEQ ID NO: 137073 - DNA, 3834 bp, Homo sapiens
gagatatacctaatgctagatgatgagttagtgggtgcagcgcaccaccatggcacatgtatacatatgtaactaacctgcacaatgtgcacatgtaccctaaaacttaaagtataatttaaaaaaataataataataataaataaataaataaataaataaataaataaagtacctgtaaaaaaaaaaaagttattttaaggcctagactagaacctggcaatgggaatattaaagaagggaaagaattcaaaaatatttagagggtaaaatcagcgagacacctcattaaatggcagaagtggaaggacaagttgaagaatgctcaccaattttctagctcaggtcactaggtttgtattgctgcttgttgacagtaatggataacatggtgaactctaggattgtagttaactgttaaaagaagacatgggatcataagagttttctgtcattgaagaaatttaaggataagccaaagacaggatgttgatggtccatttcaaaccttgaaattctgtaattctagcatcaacctttatttgaaatgatagaatccattgattttttttttaaatgtcatatggcctgaccaaagtgagtcattaggagatcagatagattccagttaggtgtgttgttccttatcctacctgaaccctagcaactcatcaatctttctgtataagatagaggtattatttctaaaatcatgctgtactcatgaatacataaaaatgatcacttatgtctgattgtatactaatgttttagatttaaaaataggttgacctttatcaaacttttgaactgggctttgccagtggttgtcatgagtatgtcattccctttgattattcccctaaatatgcattactacccatgtctttggatttggtgcaaaataaacctggtctgttaaagattctcaaacacagccatgtttttcttaccacctactcttaaccagagatcactgtccacaatttcattcaagtagaattccatgattatactaaagcagtacagtaaataccactatctctattgaatacgtttttctcttgtataaaacaggtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagtaagtcaaatcaacatgtgagtacatagttagctgggttatgaagcagcagtgtttgctctgccacctgataagtaggaggtaatgaaatattttaaattttcctttggctcattatatattgcatgagggtatattcatatcattcccccctccatttccaagtatttattcctataaaattggcatatatcattttcagttttcctgggtgagaccagcctaaataattttacaacaattacatttaaaaatctttgcgtgctttagatagaacactatcatatcctttatgtcattttatctcagttgataaaatgtttgtgtacgtaggttattagagcccacaaaatgaatcagtaagtgtgcttttaaatatacttctgcttttagagctaattgtatttgtttaaaattttgtccttgccagaagtattaacctcatgggagtatttaatggagcttaacttcctggtatattatgtaaccttatgaaattcaagtatacttataaattgcacagtttttaatttcagacagcagatgcttgggggaagcattttactttcgcagatcaatagctttatgaatagaaacacagagataatttatgaattgttgattttctccagtacttgtctcccacacatatgtgatcagaaactaactttttgaaatttactttctgatattttcacttgaatggtcttcaagattgcttgaagaagaaaattatctgaaatatgttgaagaaaatatattacctagctgagatagattctgaaggcagtcactagtgaaattgtaatttgttaaattattttgcaagaagccccctttttttaagcaatcttaaaaaatggtaaacgtaataacattccaagagtttttgactaattggtgaagaagtatagaaaattgcaagtacactgagtaggataatggtcttagattcttaggaagattggctgaatgggagatagtaaggtaggctgtacttttatgttgcatagcaggctgttgaactttttgagagttatttcccctaacttcacaagcagactatatgtttgtagccatgagctattaacaatttgtatatcaaaataacctaccttacttttattttcaggctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaatgtagtataatagtagaaaacaaatagtgattgaacttaagattttaaagggactgttatatgggcttgacaaatcctgtacaatacttagtaccattttatatggaaaaggggattcaggatgaagggctctattttagaatgcaaataaattaagagacttattttttaatgttaggcagttttgaaatctcatgcttttttgcttgcatgacatgatttgggggaggagt

SEQ ID NO: 137074 - DNA, 1239 bp, Homo sapiens
accgtgcctggccgtatggatttttatttagccaatattaatttagcatcccctggaaaccaaatatgaataagatattatccctgccttctctccgtacacacatctaagatggaagatttgtgtaagtatgttatgcagaacctggaagaggtaaaagatgggtattttgggggtttgcattgcagcaggggttacatcatcacaccttacagagcaagatctgggaacttctagtagtttggcccaaagggtggtgtgttaaaagaaactggaaaggtaggaaggacccaaaatttctaagtttccttggctgagagatgtttagacttcaccctgtagttaatatggaaccagccactggatttaagccaaagaagaccattgaatttgcagtagtcttcctacctgttttaacagattccatctatcctctacattgctgccaggatagttctaaagcatagaaattcaggggaacagatgatttaggcttgaacttcggatatggtgaagattaagagcacaaatttgaaagaagtaaagtccacaaactcattagatgtttttcacatgtgtgagggtgcttctaactggaataggaaatagagaagtggagttctggaggcagaagataatgaacttcctgtaggacatctaatttgcttagagattagcagttggatatgctagcctggaattgggattggcctggaccagaagtatgtatctggctgttcgttgaggttgtgcttaaagccagtaagatcatacaggatcaagtgaagagaaaagtgaaccaaatacctgctaagaaacagcacatagagggcagacagactgcaaagaaggaagcttaaacaagccatggtggtggtagacaatctagatcttttgaaaaaataaccacagcatgctgcaatgaggattaaagggattccattgagtttccaacagttggtgacatttgccagagttccttcagtggagcgacaacctgattgtcatggatgggaaaaggtattgaatttgagagtgatgggtcaatttggtcttcccaggagcccaagatatgaaattatgttggcctttggtgatctcacccattttaaacattgtgtagcattatcctaaaatgctttacagagtaatagctttctaaatacaccttgaagcaacccatgtgatgttttacttacggttgaacaggaaaatgagaatggcattttttagtgtggc

SEQ ID NO: 137075 - DNA, 1012 bp, Homo sapiens
atatttgagggtggaagacatgagcagaagtgtattctgattgatgacaatcaggttcagtactgtccttggttttgggcatccactgggggtcttggaacgtatcctccacaaataaggggatactactgtactctgaagttttgtccaacaaatctaggtttattatatttcaacttatccattaattctgttatttattcatttttggataatttagtaagaatttttaatccttccccacaggctgggccccaggctaagtggtggtaaaagagatgaatcgatttatatgcttcctgcctttatggaactctcggcttcatagggagccagcaaaacaataacagatatgtgatcataaatcttgaagtaaagagaaagaaatcaggatggtctcaccatggcgctgatattttagctgatttctgaaggataaagatgagttacccatgcaaatgccaagggaaagtataccagatagaaatacaagtacatgaaattttctaaagagaaaaaatcttaaactgaaagtgtgttggaatactgtgatgtgctacctagatacacctttattgaatgacttattgtcccagctgctgggagtgctaagggcaggcagccttcagtgttaccaccttcaggggctccctcagctgcagagagccatattaccaaggttacctctttctcaagatagaccacatccagtgatggatttacatgggagtataaggcttggccatctcatttcaaaggaagataaccctgaaaggctatttctagccacactgctccatataggatcagtctattactgggccagtcctgcagctctgtttctctctgtgcccactcccttttcttctcctcccttcacataggttgctcccaagggcacttcctaataaacaccctgcaagttaaatgctatctcagagtctacttcttgggaaattcaaactacagcacctgctgtggccatagcagggtgcattaaggtaaactatga

SEQ ID NO: 137076 - DNA, 1004 bp, Homo sapiens
caggaagcaacaaaaatgctccaagccacaataaaatggtagattggttttttgtttgcttgtttgtttttctcttgtgtatatttccattttactgcaaaacataccaaataattgattgtagattttgtcacaaggaatcatgtatgctgtagaagtatagagattttccactttttttgtttgctgctggatctccagcacctaagaaaatatgtggcactttatttaatgtcactcagtcagtatctgttggataagtaaataaatccagaggttgtttaaaattacgtacatgggaatattgtcaaaatgtcaattcatgatccaaagaaaatgtgcaattgaaatctgatatcttcttttttcttccacagagcccctccccagaaggcaaaggatcacccagctgctggaaggtgtaggtaccctcaatggctcagtagccagtgtagatcctgtctttcgtaatcagcagctacatctggctactgggtctctgatggcatcttctagcttctgcttcagtgtcctgagagagattattgggcagtctttaataatgaaaactttaccttgaattacacacacacacacacacacacacacacacacacactcacacacacacacaaagagagagagagagagagagagacagagagagaggagagagtcaagttctagggtgttaagtccaacattatcagctggggcttgggaaccttcaaggttttatgaatgatgaggtctatttgctttcaatactacaagggggaggaatctggatatttatccatgttttacctcttacctgtttttgttttacctctttttttctctttcccccctatgaaaggtatcatttggatagatcaatctattcatctatctacctacctacctatctacccctacccatccacccatttatccatccacccatccatccatccatccacccacctgcccacgtacctaccagtttatctatccgaccttcc

SEQ ID NO: 137077 - DNA, 1029 bp, Homo sapiens
caccacactcggctaattttttgtatttttagtagagacggggtttcaccgtgttaaccaggatggtctcgagctcctgaccttgtgatccgcccaccttgtcctcccaaagtgctgggattacaggcgtaagccaccacgcgcagccccaatttgtagtattttatccctcacccgcctcccaccctttccccgaagtctccaaagtccattgtatcattctggcacctctaaaaccagacatgatttgttttcttgacttcggcttgagagttccaatttctaactctaatggactttaatcttagaaaatcaggggatataatcatatggtagtgcaaagagtatcaaattttgtctaaggatgacaatcaaagggagccctatttttttgttttgtttttcatcaaatcctcgaatttattccatccctaattccgtggtccttcatggcattcataggggcagctgtgaagaaaagtggtaatgtacctgacgactctctcctgtcggtgtcagggttgcatttactattactgatcccagtaataggatgagtttgatctctcagcatgaaaagaatgaccatattagggatttgtttgttctccagactacagaaagtttgataaccagagtaggacttactggagagataatgtcagaatgaatagagactgtctgtgagaaatttgaacgggctcagtgctgttacctactagctagaaatgggaagcaaggggatgaatgtgaggttgggggcattgagtcaagaagaagatcaggcaattctggagctaggtaaattgggatcattcctggcttgtcacatctacgtgggacatttagactatccacgggctggataccttaggaaagttccttctggctctgggactcactgctctttcagcattgccaatttacatctagtgtgttcttgttagaagtggaaggctcctcttcatttttgagctccttgcgccctgtcattttctctgtatgagagggttttgctattcctttttg

SEQ ID NO: 137078 - DNA, 1193 bp, Homo sapiens
gacattgcacgggtgagaacagacataaaatgtatatgtaattatatcgacaacatacagggcttagaaaggggcttgatagccttttataggtgtcgtccaggtttatcttacttgaaatactgcctgagactctatacctaattcttatcacatagcctttctattagtcaatgatagatttgggttgggttaaccctcatattcttttagcaagggacccacctgcagaaaagagttattattggttttgtcatttatagtttagttcaacaagaccggatttcctcaccgcctttggctgaaactgactgactaaatcagtttcacttgtggggtagagaaatgagtaatttgggaacatagagtgttgtgtggaggagagcttagtttgctcctcttcatcctccccttaggtaagaagtctgcattgagagagggagaaagatttgggacatcatggggaaactgacccccttgggtgagacacattgggaattaagagaaagatgtaaaaatggaccaggagaggatgtacagaagccccaggggagccagagaatttctggtcctaagctcaagtgtcagcctcagttctgcctagcatcttggacatgctgtccctgctggcttatctcctgtaagacaaggggcatactcctgacttactgagcatcccatctcagaggagctgggagtacaaggaattcaggaatggactttcaagacaacatctaacccgagtcttctgcagacatttctctactgaatctactttctaagtgtagattagtgtctaagagatagacattaagtttctttttctaccagcctctgacccccttgctttgaggaaaacacatgtgttgtccacgaagtggtgagttctgtttggtccttcctctaagattggtccggggcttgagccgttttgccccatgtgctctgggatttcccccggttgtccccccatataagtagacaacttgctgtctgtgttctaagaccttcatatttttccctttgacttgagtctgttctggaacaattgtgtggtggctgggcactgcaaaatgagtcagttcctgcagtttggttacaagttctcaaaaagtatttcagaatgtggatgtggtcagcagagtcattttccagacatctaaaaggaaacccacatcaactgtaacaattga

SEQ ID NO: 137079 - DNA, 1038 bp, Homo sapiens
acaagagaggactggagatgtggcactggacttcttaactgagtcagagggggtgtttgagtgatttactttattcatagtcaccctatacctcctacgatcaagagctggtggtatcaccactatggtcattagccggggctgtggttgaatgcttataacaggttctcctgggtgggagtgtaggaattccaggggtctgaactctcctcacaggcttcccaaggtgatctccatcagtaaatcagcccgactttttcatcttgaaaaattaagacataggaaataactctttccttaaccctaaggaagtttccttgaacagtgggaaaaacgtttttgtagacattccttagaccccttacccagcaggaggtgtggaatcaataaagagggcatgggtcacctccaaggttgtgagctccctggcttgggaactacactgggacacagcagagcctcttggcagaaatcaggcagcccatggagcttcagctgcatgactctttgaattcacaaaaggatacctttaacagtacttctcaaaaaatgtatataaggcatgtctcaagtccctatatgtttctagggataaaaaaattcatttcaaactgatggcaacctccccattctattccccagctttctatccttcttcctgcttaatttttcttcttagcacttgcctctgtctgacatattgtatgtcttacttatttattcatttgacattttaattagacactagcagtattgttttctttgaatacatttaaaggtcctagatttatttctttttgatgctcatcttctaactcattccctcctatcaatctcagactgctgtaaataaatgattttttgccttttttttttttttttactattagttatcatatttatttttcttaaacaagctgtactggttatacagtctgaatttggagaatagacgtcttcattcaggaggggaaattgagccaagtttgaatataatcattgggtaacaaatccagaagattaagttactaaggagaa

SEQ ID NO: 137080 - DNA, 1041 bp, Homo sapiens
agaaacaggttggaacagtaaatgctagaaagtatatcccagaagaattaactgagaacttcatgttttcaattctatttgccgttctctgttctcaatttgttaatttttaaaagtacatcgaaagtgagtagcattgcttgctctgaattctcctctggggtcattgagagtattcacattttcgtataccctgttaaaagatattaatgccatgcatatgcctttgtctttgtgggtgtgtaaaacaacaaactgaagggatctggtcaagagacagacctcaaaataatttctctgaaatagtgtttgaatttgcatgttcgggaacgtaaatgctttccctttgggcttgtttcttaagtttttggtgtagtatacagttttacccaattaaatttttcttttgaggtctgtatatgtatgggtgtctatatttgatttgaagggggagttttaatcattagtgaaacaagtggctgtttgttagaacccagataagcctcatagtgttgttcctatgacaactgagtagttgggtgttgaaatgtagctttaagttcttggtttggaaatgtcattcagacctcccactatagtctcattgagtaggaggataatgagaaggggaaaaaccatgaagcaacataagtatctccgttcgtttcatgtcttcctgacttgtctttgtgtacaggatcgccatgggagtggtaaacataggtcttgaacaaagcaatacttcaattaaaaaaatacatggaaagggtcagaaaagttggggaagataaataacaacacatgggggcaataaagaggcaagagaaataggcttccatgggtttctgcaaatcctttatccagtgctgaccagcagtgagaacatcttgaaccagttattgtatagctcttcaagagctgtgaatttccttaaaatgcaatgtggagaaaattcctttggtagcaggatggtttaccactttggcataacgtttattcatctcccccaggcagactacagaggatactgtgttcttttaa

SEQ ID NO: 137081 - DNA, 1069 bp, Homo sapiens
atgtcacggccctgtggagcgaataaacagtggatcttgggtatttttttctgagtctgtacccatctcttcatgcctctgactaggggcccttgttaatgtcaagggcagtgctctgtccccaacagagctgtagtgttgcccccagtctctgacccactcaccttctttcctggctgatgacacttccaatgtcctgacacatctgggcaaagtggaattggagttcttaaatgccctctctggctggccccagctcgattctgcactggccttagcaggctccaggaagtttggagaggaaagacccaaacagatctcagatgtaaaactggatgagtatttcaactgctgaaactttaggaggaaaatatggatgggctacgtgtttgtcaacattagtaaaatagttactagtgattctttttttaaaaagttatggaatcatatttttctcattcagaagtgttacttagggaatgactgaaatgtgtatgactccagagttctctgtcagacactgttctcagcacttaacatagaatcattttttaatccaggtgccacagctaggaacagcagaaccagaagtcaaatcccagcaagtctgactccagaagctagactcctcagagatgtcataggtccttttagatgccagagttttagatgttccattttattcacattctattttcatagcctgtgtttatttccactgaaagccatataattatagactttatgttctgtatcttagcaaggtaactgtctttaagccaataaaacttaatacattactactgaagtatgaataagttttaataactgagaaatacatacacatggttaaagtagaattcaaaagtgtaatttggaagtgctctcgaaatagtttcgtgtgattttaatttctgaaaattaattctgtatgtaaattgaatgtagtgtttattccagtaaaaccctgcaggaagtctttttataaagtgaataatcaactcctgaattaactgttatacatggtttcagtgtgtataccttttctgtgctctcatctaccaatctg

SEQ ID NO: 137082 - DNA, 1094 bp, Homo sapiens
cctgggcccaactgatcttcccatctcagcttcccaagtaactgagactacaggcgcacaccactgtgcctggctaatttttttattttattttattttattttattttattttgtagagatgaggtctcactatgttgcccaggctgttctccaactcctgggcttaagcaatcctctcacctcggcttcccaaagtgttgggattataggcgtgagccactgcactcggccacaagattgttttttgtttctctcctgaggaactgtaaggttagtactgaaggtgacagctcacccttagagagctgatggtggtagcagacatattgaggcagcagtctctgttccttgcttgtattttttcgcttattcccattcttcagatgaagtgaaagccttagagaaatgaagggactcttctatgtccccacaggtaatagcctcagagacagtattacaacccaggctgtttgtctttaccctgacttgtaactttggtttctgggagcctgacacagttggatcgtttggtattttagaacttacccaagacaggagtggcggtggacaggaagctccatgctggagctccaaaccagccttgaactgaactgttgaatcaggtctgtgtgcatcttcaaactgggctgcgacatggaggggaacagaatggagccttcccccatcactcatttgtaatcccaaccaccctctcttcattttgctggcttttcccccattatgttaccatctgtctccaaaacattgcctgggtaaagacaaactggagcagttgctcgccctcaaacaaaacacagaactacttctcctcactcccattcccccccacactagtgccgagcaccatatttgaggaattccatatttataaagcttgcctgcacctcgatgatgtctgcttgctgtcctttttattattcttcaaatatgttatgtgctgactggaaacgattagcttttgttactgaggggtttgtgggatgcttgaaacagcttcatatagttctcagatggaaatgcatgctgtttgctcctttaagaaatgcaatttcttaatgaaagacagcatag

SEQ ID NO: 137083 - DNA, 1035 bp, Homo sapiens
cagacaatgtattttagctcatttgtgtagtaaaacatgtaacagaatctcagtagagttcaaatatgccctcttgacttcctaatgcatagactccgttaaaatagtattttagttgtccaagccttccgccttagccattttacacctggtaataactatgtaaattcagaaaaacagattttatatgttttgatccatctttttcttaatattactcttagtgaagatctgcttatttcaccctaaggcaattcaaaagttctgtatgacaactttattctcactgccaactattaggaaaggaatgcccacttttccctgagggcgtgttgttgcatgcagcattcccattggaatgctcttgagaggttgaactcattctctgagcaattgtttttatacattcagtattttgcttccagtgctcatggccagatagtgtataacctggtctctacccagtattatccatgctgttttcacacttacctccaagggccaaagattatctcacagaagctccgaaagaattcctgtttctgaaattcatgtgtaaaaggaaatttttaaagggaagagggtgataattgagttcaaagtctgaagaatttttgtcaaggattatattgattaataacagaagctctctggcattttcaggcagacatgtgaaaaaaagtagtgattgtaattaatttttagtgagtgccgcatatttgataattgctctgattcacgctattatattcctcttccttcacccacagcaaaataagcttaatttgattcatacccttaggaagaaaaaaaaaagcctaagattactcacatggctgtgattcagctcttggctcccaccacctcctccgcctcctcatcctccctttctcccaccctgcccactcccatgttcactcccacccagtggtgttgccatcaaaaaactgagtcagtttgttctttaaaatgggtggggaaagaagacaactaataaaaacttttctgagcgaagtatactgcttagagctgaaa

SEQ ID NO: 137084 - DNA, 1023 bp, Homo sapiens
tacctttaccatctgatgaaacaaaaacttgcttcttgactctacagctaaaactaaattgggagtatttttttctcattaacctttttattaaaatgcaagttctttttcaaagatgagagttatacatagtaagtcgaagatttctgaaatccttttagtccagcttagaagaggaccaagaagataatgcttatgtaaatctgaatccagcagatactctctccactaaattaagagatacttctctcatgaagagctttgttgtgcagattttgcagtgccacgttttcgattttgaatgttgcatatgcttataaatcccgtagaagtgattcttgtgataatagtttaaaaaacttagtgaaaatcaagagaacaggcttctatgaaaatccgaagtgaagttgtgcatgcctcccttagtagctaatggccaaatggttaaaggtgttaccagggtggtgaatgatattcaaagacctgttgttcaggaggggtggggagcaggaagctctgttggtgtaagtggagaatggaatgttttagggagccgggttttgtcatttccaggagcagggcgggcagcacggtgggaaggtctggctccagcttgagcccactcacaggatgtcagggggaagtgtgactaaggtcacggccacgccacgtggtgggccagctggatccagagcaggggccgttgtggccacacatcctgagtttccatggtctaatgcagtgggcttgaaaaaaaagggtggatgcaggatgctggctgggactgtggagtgcgtgggcagtaagtcttaagtgacagtgggtggagattacagcatttcatctgcttttcctttgacaccttttaaagatacaacccacagttttcaagggtttatgccaatgtctgctagagggatcttgcagtagatcttaaaccctatagtattcttaagagcacaaggaaattcttatttgggttccatttacaacaaaggtggaaatttaaaactaggctgagaa

SEQ ID NO: 137085 - DNA, 1508 bp, Homo sapiens
aatttctctgtaagcactattttagctgtatcacacagattttgatatattgtggttttgtttttgtttttgtttttttttttttttgagacagagtctcactctgtcacccaggctggagtgtagtggtgcaatcttggatctctgcaacatctgcttcccgggttcaagtgattctcctgcctcagcctcccgagtagctgggattacaggcacctgccaccacgcccagataatttttgtatttttagtagagacagcatttcactatgttggctaggctggtctgaaactcctgacctcaagtgatctgcccacctcagcctcccaaagtgctgggattacaggcgtgagccactgcacccggccgatatattgtatttgcattttgttcaactcaatgtatttttttcacttgagactttcccttcactgaaaaattatttagaagtgtgttgtatcatttccatgtattgggaaattttccttttctttctgttgttgattgctagtttaattttatcatggccagatgacatactgtgtattattttaattcttttaaatttattaaaggtttattctttagagtatggtctatctcagtgaatgtacctttttggcaccagggactggtttcatggaagacaatttttccatggattggtatgggggtgggaggggtgagggggtggggggatggtttcgagatgaaactgttccacctcagatcatcaggcattagattctcataaggagtgcacaacctagattcctcgtgtgtgcagttcacaatagggtttccactcctatgagaatctaatgcgtctgttgatctgacaaaaggcaaagctcaggtggtaatgttcactcgcctgctgctcacctactgcggtgcagcccgttctggtactggtccatggcctgggggttggggatccctgggttagagtattttataaatattaaatttaattgattgatggtgttttctgtctatttctatatattactgagagaagagtgttgaagtttccaacgacaactgtagatttacctgtttctcctttgtattctgtcagtttttggtttgtgtattttgaaggtcatttgttgggtagatacgcatttagaattgtcatgtccacttggcaaattgatacttttattattattatgtgatgttcttctttgtccctggcaattgtctttgtcttcaagtctgcattgtctaaatatagacactctacttttcttttcaacagcttgcatgttacaccttttttcatccttctgctcttaacttacctgcctatattatatttcaagtgagttttggttggacagcatgtagttggttcatatttatttattcattctcacagtctctgcctttaattcttgtgtttagaccatttcagtttaatgtaatagttgatatgtttggatttatgccttctgtttattccatttttgttcctatttctcctattctgtgtttttttttt

SEQ ID NO: 137086 - DNA, 1020 bp, Homo sapiens
agataagtttgaaggccaacacaggccatagtttccaggatcatttttcatttcttatttgtgattgacagaaaccatagactagggtctttcaaaagaaagaatggtgcccatttgcctatttattgtttggataaagaaatgaatttgactgtgtgacctgttactaaataagtttaagagaaatgatggccaagcaaaatatgcggaataaatttttaatctgaaggtaactccctaaatcccaggtattaccttctcacgagagaagaaagtggctggaaagagttgtgaagagttgcattcctttttttaatggagatatggtcactgtttagaccacaagcaaacagaagaagcccagcagcatttcttgggtatagttactcatcttctcaaatgttgcaaaataccgaagggaagggaaaaccagaagttggttggggtgggtgggcttggtggtttaaaaaatatggtgactaactgacttgtgctgactaatattggtgaactcataatgagtaacaatagtgaatttaggaggaatataagtagaaggagagctatttaaaggttgctttaatacaaaaggcagctgaagcggtcacaataaggattcccttagggaaattcggaagtaactccgtttacccttacaaagttcttgtttcctttagaattcttacaagtatggcttcttttccactggcctcctggggggagttcttggcagatgagcttgctcgttgttttgcattgaagaaataccatagatgtccagtaagcaagagcaaccagttgattaaaacaaggttggcagtaatgtctgtgaactgaaaccataaaaggtttgtttgactttttcttcttaggggtttttttttttttcttatcatggtataaaaaagtacaagaactgaccaaccatctttttcgtaaacatagatgctatctttttaaaatgaaagatcataacattatttataaatagagcaaacatacaaccaatcaaaatgtaca

SEQ ID NO: 137087 - DNA, 1056 bp, Homo sapiens
ttgccactttgctctttcaacttaagagttattgtttctacaaatgttgtctccttagagaaacttctacgtttcagaggaacggatgatggattagtgtttacagtaatgagagagtaaagagaggtttggtagagggggaaccggtgcgggaaccattcaaaaagtagccgtagctagtaatgcttgtatactccctctacgcatgaatgattcattttgccgctttgttataatagccacagtgttcagtctctaaggctgtcttgtgatatatccttcttttgctaaaaggctacatatcagcagcctcgtttgatttagaagccgattcagcataccacacataccatttgagaagaatgccaggacccttcctgctatgaaaatgtcatgcatgcttaaaatgacaaggtttggctcaagcaatggtttcaagtgcttcttaattatcctttttgaatcttcaaagcaatttaattttagggttttcattttcagttaagatataagtcacccaaatatttgctttatttttaaatatcaaaatgctgacttggcgatttagagtatccaaaatgtagcatgaaggtggtaccttttaaactgtggcaaaaaacatatcataaaatttcccaccttaagcatttttaagtgtacagtatagtagtgttaatatattcacggtgttgcgcaacagatctctggaactttttcatcttgcaaaaccgaaagtatattgaacaactccccattttcctctcccctgcagcccctgacaaccaccattgtactttctgttaagagtttgaatactttagataccccatataaagggaatcatgcagcagttgtctttctgtgtctggcttatttcatgtaactttatgtccaacaggttcatccatgttatagcagatgacaagatttccttatttttaaggccgaatagtattccattatgtacatataccacattttgtttacccattcatctgtgaaggcagtttgtctttttgtaaagagtggtctcacgaaagcttttcttgggaggta

SEQ ID NO: 137088 - DNA, 1035 bp, Homo sapiens
tctgtgcctgtgtttataaataaaattgaaacacagccacgtccatttatttacctaattgtctatggctactttcatgacgtcaatgtcagagtgacagagatcactatatggcctgcacagcttaaacctttactctctggcccttatggaataactttagcgccctggtatcaataataaagggtaactttttgtatttgtgtgaaattgagaaaagtatctgaagaatcttgattttttttaaagagaaaaaaacagtcagtctaacatttaatagattgttatcttcttccagattacatcaatcttccagattgccttagggccctaatcacaggtcaaattaattttgccccttcaaccaatccttttcaaagtactgaagataatactgtcatcagatgctgacattactacacaaatgcagtatttcatcagtgaattgtgtgtttttatatatcatgttgatgcatgccacttccctcatacagcgcagtgtgtatttttcactggaaccttccaaccttaggctcttccttccctggggtgccgccttgtggtgggctgtgagcccttcatgggcaaactgcatggtttggtcatcgaggaccgtgaatctgctatggagtgactcatgccaaaccctgccaagagcaagctgtcccatcatatacctaagaggtcatgaatcattagactggaacaacctgctggtgaatacaacgtggaaaaaattcctcattctactgattatcaacctcccccgtgccttctctatatatgggcttaagaggaaacttttaaaaaagaataaagaaatgactcattagggctttttggggatagtcttaattatattttagctaatgcagtatttttcatactttgctgtatatggttatatatatgctttaaaataataggtacacatacatatctctatatgtatccatgtgcacacatggatgtgtatgattaatcttgattctggtaagcctcattattgaaggagtttaagagaagaggctgtga

SEQ ID NO: 137089 - DNA, 1028 bp, Homo sapiens
ccccacactccatctgtcctaaactattttccattcctagaacattccttgagttctttcctgcatctatgcttttgcacatgctgtttcttctatttctgatgttcatgcctgtctacctggcaagttactagttttcctttaaaagccagctgaaaagtggcctctttgagccttccttttctttaagtagatcttgttattcatctctcatttagtgtggttggaggaagtgattcataattgcaggcagtaatgcatattaattattatacccccagcaactactggggcactacttgaaaacaaatgatatttaataaatgttcatggaatgaatgaactcatggagaacccatctgtgctcagattttgttgcttaacagctcatcacaatatcggtctacttagtggttttaaacaaccaccatttatttagttcttgattctgtgggttggcaatttgggcaggactcagctggatggttctttcaatctgggcaggtcttctgaccttggccaccttcacttgtgtctgtgatctgctgtgtgagttggaggctgtctcttctaggatggcctcagctcctctctgctcgacattgtggtctttaatctgtaaccaggctagcctgagcttgttcacactatggctggccaggttctaattgagagtgcagaggcaaccaaggcctcttgaggcctagacttgcaactggcacaagattatttcctctgaatttgttagccaaggcaagtcactttaaagccagccctgattcaggaggtgaggaagtaggttctatctcttgatggaaggagctatttatataatcacattgcaaggaacatggatagagagaagagaataattgaagcctttttgcaagcaatctactacacttatttgggagcaggaatggagattagagcaggttgggccaaggaggtttattccacttagatcagcagcggggtgcacagttgtggccctcactcatgggtttaattgcacctaacatgagccc

SEQ ID NO: 137090 - DNA, 1035 bp, Homo sapiens
gatggatgtgaggtggtccttgtggttttaatttatatttcccggtgagtaatgatgttgagtactatttcatatacttaatggcactgggatatatccttttgtgaagtgccttttcaaatcttttgcccatttttgagttgggttgttttttggttggttggtttttcttgtaaaagttcttttatatcctgcatatgagtcctttgccaaatacatatgttacaaatattttctcccagtctggtttgccttttcactgtctaaatggaatcttttgataacttggaagtctagtgatcaatttttgccttttaaaatggctattgttttttgtgttctgtttatgaaatttttgcctactttggggttattttttaaaaaccttgtttttagtaactgaaaacatatggagacaatctgtttggaagatatagtaaattaactataagcatatttcaaatatgtgccttgagtgtggaagttggtgatatacaccttttctgcagcaggtggcagaaaagggatttgaagcaagtatgtttatatgtttatatgggcatagatgctattactcaagtggcctccactcggggcccctctagattgggaagaaccatagggaagagctcagtgataactcttctgtaggaaagaatgtggcaaaatatatgggtatctatactttctctatttgtaatccatgcttgccaaatgattctccccctcccctcttctatccccaaggacagtcactgctgttcagtgctgcagctttccttagcccctcaagatcctgccattcattagctttttctcttcatctttttcttgaaaggtctgcattttctgtcactttgatgtcttaaaatgtcccctcccactgccccatgttcttcagacccttcagacccctcaacccccacatctttatagcctgttcccactactatccctcaactcaggctgcaggtatgtatttgttaattgcctcctggacatctccctctggatgtcccacaggtgcctttcata

SEQ ID NO: 137091 - DNA, 1181 bp, Homo sapiens
tgagcacaggggactttactgatggtacacgacaaggtggggctccctaggtccctccctcttcaagtggtctgcatggaaactgtgaggaggggagtgtggtgggggactgagtgtggcaggaactccccagcagtgagggtctctctcttcctcttgtgctctcgctggagttggtggtccaggagtcccactccttggaggccatgtgggccatgaggtccaccaccctgttgctgtagccaaattcattgtcataccaggaaatgagcttgacaaagtggtcgttgagggcaatgccagccccagcattgaaggtggaggagggggtgtcactgttgaaatcggaggagaccacctggtgctcagtttagcccaggatgcccttgaggggggccttcaacgcctgcttcaccaccttcttgatgttgtcatatttggcagggttttccagacagcaggtcaggtccaccactgacacattggcagtgggggcatggaaggccatgccagtgagcttcccgttcagctcagggatgacctttcccacagccttggcagcgtcagtagaggcaggaatgatgttctggagagccccgtggccgtcatgccacagtttcccagaggggccatccgcagtcttctgggtggcagtgatggcgtggactgtggtcatgagtccttccacgataccaaagttgtcatggatgaccttggccaggggcgctaagtagttggtggtgcaggaggcattgctgacgatcttgaggttgttgtcatacttctcatggttcatgcccatcacaaacatgggggcatcagcagagggggcagagatgatgacccttttggctcccccctgcaaatgagccccagccttctacatggtggtgaagacgccagtggactccacgacgtactcagcaccagcatcgccccacttgattttagagggatcttgctcctgaaagatggtgatgggatttccatttgatgacaaatttcccgttctcagccttgatggtgccatggaatttgccatgggtggaatcatactggaacatgtagaccatgtagttgaggtcaatgaaggggtcattgatggcaacaatatccactttaacagagttaaacgcaaccctgctgaccaggcgcctaatacgaccaaatccgttgactcc

SEQ ID NO: 137092 - DNA, 1055 bp, Homo sapiens
ctggccagtttttgtttttaaatcagtgcaagggccctcccctcagagattcagattcagtagcttcaggtgggacctggaatccatgctttgtttggaacctcaggagtgttcttgatgtgcagccaggattgacaagagcctttagtctagagctcgcagcagacctctagactatttggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttggagccttcgaggaaagagaagggtgacttggggtatgtatggggagaactaaaaacctgtcatcttggttcccacttgtggggaataaagggaaggtattgtcttaactgagctgctaactaatcaagcatgaaggtttctgggaagctgttttgttttttttttttaatttcacctggaattaaattaatagtcccctctggagtcagattttcttttccttcacctatcctcatgcctgagtccacactggattcctcagaataagggtgggcccatttactgctggagcaaagtagaaggttgtggtcctttgctatcacatggtgatggtggtggtttccgtagcaggtaattaaggagatgcacacttttgtatagccctgacagagagaagatgaaagctgctattccttttagtacactttttgagaactaccagaaacctgaactttctctcctagggaagaaaatttggaatttaaataaggccacatttcttcctaggacacaatcacaggaagggcatatggatccgagcatccagggtggttactggggtgatcagacaaataagcattgatgcctggaaggcagaaatcacactgcgacatcaaatgtttcatcaagcaaacagcaaggatctcttcaggctgtgttctctagacccgaaaatgtcctctgtggttt

SEQ ID NO: 137093 - DNA, 1052 bp, Homo sapiens
ctgcgagctctagactaaaggctcttgtcaatcctggctgcacatcaagaacactcctgaggttccaaacaaagcatggattccaggtcccacctgaagctactgaatctgaatctctgaggggagggcccttgcactgatttaaaaacaaaaactggccagatgatcctaattcacagccagggttgagaacctctgctctagaacatcggactcggctgaactgtcgtccccaccaacccagaacaaatacgtgtataagatggacttgggtttactctcttggaagaactttgtttatttggatgtaccattacttagcagtttcaatctgatcttatgccagactggcagcagatagttggccttgtgttgaatgatgcctgacatggcataggcaaaattcttctagatgtggaaccacttgacgaatggattcacattcccaggacccctggtaaggtcagggttattctccacatcttacaaacaaaaattaggaccaaaggtcaaaaattaggaccaaagtgccttactttgattcaccaaatatttgtaatcaaataaggacttagaacactggaaagcagttctgattccaaatggctgacagctcggggttagtgacaaaggcaagaaagggagaccagcctgcatttccagcttcctaacacacaaagaaaggccggggtagggttactgggcaaatgctgcaactagattctgggccctctcttccctgggtaggacttctgggtgggcctcctgccctatacaaaccatccccaacccaccttgtttacattggaactacactgtcgtagacagcaattcagggaagaggacaagccataattaggatttcctccctgtttcccctgtcatctccacacaggaaaaccctgatgggaagcccacccctctagttttggtcttggcaatctacatttccttgtatgtgagtagatcagaatcaaatgtttgcagtgaagactacaagaccctttggggataaacacaacactctatgaattgaactaagactaggaagg

SEQ ID NO: 137094 - DNA, 1064 bp, Homo sapiens
tatgcatctctgtctgtgctgtggcactttggagggttacaaaccatcataatatctgagtggttttttttttttaacctacaagaaccaatttttatacccatgagggtgatactgcctccattgagaaaacgtggttcagtgcagtgatttttcaactgagggcaattttgccgcccaggggacatttatttggcagtatctggagatgtttttagttggccacaaccagaggaaggggtcaaaacctcagcttcttggtgggtggggttgctactagtatcttgtgggtgaaagccggagactctgttaaacatcttacagtgagtgcaccatgcgggtcaccacaacagagaattatctgacccaaaatgtcaatgctgccgagtttacgaaaccctgctccaacatgatggtaagattcaaatgcactctaagtaacccagaaattattaaggaaggtgaaggtggaccatgtcaattcaaaaggctacaagctaaagagaatagcagaagttgggttgccgactttcaggttgatcctatgtacaacatggtgtgcttgtctggaaaaaaaggccatctttgtcttcttaagtattgttgctgtttttcaataatatcatgctttttgttctttctgtcaaatatgtgtaaaaatatgtgtaaacactttaaatatgtgtaacatatttaagcaacaatttcttttttctatttttggtatctttataaacaaatgaatttctgaaaaaattatgtaaatttgttttctatgaggtgtatttcatcctctgattttattacattatattttgaggggctcatcctcattcctgatcaatcctcatttgacctggctcttgacattgttgccttaaatttaaatttagtggcctctcagcctctctgggttttagaggatggggacagtttaagagaagatatggattcatattgaaagtgaaaaatattctctggtggacatggtccagatcatttgcccagagctcctggctctcctgttgtccctgtcacactcacgttcccttcttctgctgccc

SEQ ID NO: 137095 - DNA, 1012 bp, Homo sapiens
gttcagtagtaataggaaacttttttttcttttttttctttttctttttttttttttttcttttgagaaaaggttgccttctgtcgcccagactggagtgcagaggcgtgatcatggctcactgcagcctcgacctcccaggctcaagcgatcctctcacctcagcctccctagtagctgggccacaggcccacgccaccacatccggctaattttttgtatttttggtagagatggggttttaccatgtttcccaggctggtctcaaactcctgggttcaagcgatctgcttgccttggcctcctgcagtgctgggattacaggtgtgagccactgcgcccgacccagcaataggaaagtttcaaaaatattcaggaagttggatatgctaggcttgcctaccttaactttttgttctagcagggttttttttttcccctgcctcttttttttccattgattttttttggggggatgttttaacaggtgttgtagctgtccttttctgtggaatcacacaagctcattacacctacaacaatctgtcggtggaatcaagaagtcgaaccaagcaggtgagagagaggcttggtactcacgagttgcttgttaacacagggaagggggaactgcagggttacagcttccttttcccttctctgtgcagctctttgaggtgttacatttcctggcagagaacttcatcttctcctacatgggcctggcactgtttaccttccagaagcacgttttcagccccattttcatcatcggagcttttgtatccttttcttgttccaccattttctacatgcagagacgaccactgttggagaagctatagtaataatagtcataataataatataaaataacaataatataataatataaaccatcataaaataataattactatttctgttttgggtaggtgactaactccatgctagttcacagggtttttatgatgaaaaaaagaaggcttaagtggcatttcataacactaaa

SEQ ID NO: 137096 - DNA, 1026 bp, Homo sapiens
gtgtctgggatgcagaccagaggacgcctgcagccctttgtctggtcatgcttcatggtagctgcctgatctaggctgggttcttcttcctgcaccctgtttttttctgatgttgctcagctgacatgctggggctctcctgccttttaaaaaaattttaggtaaagtattcctggcccttgtttgatcagagtgttgggagatttttgtctgtttttgttaaatagttctgattgtcaaatgagaatggcttatgccttgaggaggcagaactgtgtcttaggatcccaagaacaggcagaatttcctccgtcaaaatatcccacaggcctaatgacttgtaagaagtaaatccttccaagacaacatggtaaaacaagtaaatccgtgtgtgtgtgtgtgtgtgtgtgtgtgtttatatttttaaggtaaccaatgaatgtgcagaagcattgaaaggattgcagttttgccactttctgaataatttctagctgtgatattgatatgtgtttcttcttgtataaacttggccatcttaaatggaactatctgtttctcatttctccacatccatctctattgtccctctttcccaggcttcagacattaatctagatgaatataaggagacgcttcaggttccatgagcagatatttaggactctgttttctgatatcaaattaagcagaaagctcatgacatagcaccttcacactttatttgttttaaacttctatctgtgatgatcttctgaggtaccaccagaactggaagtgacgtgctgtatcactgagtaaaatggtttgggttaaatctgtaaaaatgattggtctactcacacacacacgcacaacatatacacacacttaatgtgatttaatgtaatcatccagagcagttttgtctgaaaatttactaagtccttgcttacttgctcagtacctggctgtatagaagataacttaaaaccatgatgtctaaggttaaataacaccatataggagtaacttcagttgttactt

SEQ ID NO: 137097 - DNA, 1044 bp, Homo sapiens
tacatctctgctgtggtgttttgtgttgccatattttaaccacaagggggcagcatcaccaccttcgctgtctcccttccatctttaatatgagcgcattgggcccagggtagagaagaaaaggttttacaactttaaaaagcaatattcgtcatctggtgatgattgtaaatatgatagtgatgattactggaagagagttgaagaatgtttcctctaattgaggaatttgtctacaaatataaaccctctcttgttagagtagtattcatgaggacctttgctagtatgcttcagtctttccattagctctgctaataatgaggttagaaaagtcaagaaacaatgagttacatgaagcaggttctgatttttaggagaaagatagtctgtaaatgacttgttttggcttcctgatgacaatttaagttaaatcatgttccaaatagctgcctccagatgctgcagatcatcctgtattatgatgagtgttgaagggctagagtcgtctttgccatgtaaaacttcgtcagaaaataactgtctaaccagggagtgaaataagactaaaaagcatcacagagttccatctagagtggagagagagccccccagagccctgaacagctccactgccaccaatctcattaccatcacacctgcaaaggggccactgctgccacagctggccccagtcaccattactgtgaccgcaaacatgagcagtgaggctgagacacttggcatgacaccatgggcagaggcagagggagtggcagcctgcaaacaggacaagaaggttatcccagtgaaagtttgggaacagtaagatggttcagtgtaagaaatatatatggtttcgtccacaggaatgacactgggtgagatgtatttgtatgccagattgtcataaagaagaataacccccaggaaacaccctggcagtacaggggatggagaagctgtggagttcgatgttgaaggagaaaacggtacacaggcagcaaagattgcaggccctggtggagttccagtgccaggcag

SEQ ID NO: 137098 - DNA, 1002 bp, Homo sapiens
ttctctttttttccttttgagacagggtctcactctgtcatccaggctgtagtgcagtgacccaatcatgattcactgcagcctcaaactcctgggctcaagtgatcctcctacctcggtctcccgagtagatggaactataggtgcatgccactgcactcagttgattttttaatttttttgtagagacaacatctcactgtgttgcccaggctaggctcaaactcctgagctcaagcaatcctcctgcctaattttttaaattttttgtatagatgtagggtctccctatgttgcccagctggtctcaaactcctggactcaagtgatcctcccacctcagccttccaaagtgctggaattacaggcgtgagccaccacacccagccaagatcttcttaattggaggtgtgattttaagttttttcccctgggaggtatgatgcttccaggaaagcttgataaagctcttgtacttgtagcctctctctcctgcagtcaattctctgtactgctatggtatcttctaaaagtcagtcctgattgtacccctttttagtccagaagtctatgtggcctctgtttcctgtgtgataaagtcttatctcatgagcttggcttaaagggatggctggccatcttccttgtgccaacctccctgcttgacatttggtctccacccttcccctttctcccctgtgtgggctagctccagccatgccactgtatctaatgtgcactttcctacctcatgctaagggctttctctgaaatatacttcacgcctcctctttcctctgtacaagtctgactcatcttgaaaggcccaactgtgaagtcaccttttctgtgaagttttcctcaacaactttttcatctgaaagacttattcattctgttgtctgctatgtcgcctttttatgcctctgttttgtggtggttgttacagcctggttggctttattgtcagtagtgtgttggcaggtaggacaggtgtgtgtt

SEQ ID NO: 137099 - DNA, 1058 bp, Homo sapiens
tcttgtgctcaagcagtcctctcacctcagcctcccaagtagctggcactaaaggtacatgtcggccgggcgcagtggctcacgcctgtaatcccagcactttgggaggctgagggcgggtggatcgcttgaggtcaggagtttgagaccagcctggccaacatggtgaaaccccttctctactaaaaatacaaggattagctgggcatggtggcgtgcacctgtagtcccagctacttgggaggctgagacaggagaattacttgaactcgagaggtggaggtcgcggtgagctgagatcgtgccactgcactccagcctggacgacagaaagagactcttgtctcaaacaaacaaataaataaaggcacatgtcaccacacctggctcaatctctcctctttttatggttaatatctcttttgattcttttgcttagatgctgtcactctgatattaaggagaaggccagtttattgcatttgagtttgagctttaactaggttatttagtctcacacagaaaaattctgttttgtggccacattttgcccatgtagtcaggcagctgccatgaatatgtgaaccttgggctccctttcctgagagggcagccaagtagaccttggcataaatacagaattgagaggatgctggctagtgacgcgggctttttggtaggggctgcctggccaccttgcctcaagtgatctcctactgtcactgtggatgtcacatgcctcctggctgtgccacttactagtcagatccttaattagttctaaaatggatttcatgtcctttgtgagaacggaattcaccaagatgatatcagggaaatctcattaccttataaacacaaagagatcagatcaacagatcttactttgctgaagagttgggcttttgtcctctagctggcgaggagccattggaagcctttaagccagcagaggtgtttcttttagaatgactatccttgcagtggttttcaggtaaagtactgaggagtgtgagatggatgcagggaaggcaagaagctgtcaaagaaaaagttta

SEQ ID NO: 137100 - DNA, 1502 bp, Homo sapiens
tgccttcttgatttctttttctgctagttcattataatgtatacatatacatatacaatgtatatattacaatatatggtcgatatatagaaatgctactgctttttaatgctgattttgtatcctgcaaataaattgaatttgtttatatctaagagttttttggtggaatctttaggtttttctaaatataagattatgtcatttgccaagagggataatttgactttttttccaatttggatgccttttatttatttctcttttctgattgctctggtcaggaatttcagtacaatgttgaataggaatggcgaaagtgggcatccttgtcttgttccagttcttagaggaaaggctttcagcttttccccattcagtatgatgttagttgtgggtttgtcatatatggcctttagggaagctttaattttataaacgtgttttgatctttcttgttattgtaatccccatatacatacactctgtcctttggtatttatttttcttgaactgtggacttcgtgtgtgtgtctgtatgtttatacagttaagtatatgtaaatgtgtttaaatacacatttaaaacaagtctaccatggactatctttttctagtctaggactctgttgactgctgtacatttttgctgctgagagaactagggggaaagaaaagattgcattcattaatagagtgggctatgaatgagccagaatgattctccccagtggtatgaataagacaattgtctattttcaatggcagtgttatgctgagtgtttatgatggctctgaagagagacagacaagatggtgatactgtagtgatttttatccattgtgggaaaatctggtaaagagtcaaggtctgttatagcagatgaagtcctcccagcaaagttggggaaaaagagacaggtagttcagtaggagacaactgtttaccaaggcattggaagagctgagaagccaaacagagtgtgttgaagcaagctaaagatgagcaacagcagaaagctactttcatccctggggctgacacagggagaaggtagtattaccagagcccaggaatgaggttgcctggcaagaacaactattgtgagggctgttgggacctggtcggagggctgtctgatgggagcttcagccatggagaacacatagccaccaccagagagagagagagagagagatgataggagtcactccttaccctgtgacatgtgcagagcaagaaagggcataaaatggatccaagggccaagactagcatgaagattcttcttcagattgaatacctattctggtgtgtagtatatccaatacctacatacaatatggaagggaggaaaaaaactgtgtggtcagggtcaagaagaactaatatgtctgtcaccaaactcagggggaaaggaaatcaggtatcgaggcacaagctggaactgctgtggtaatatatgcctgaaggatgggatgaggtaattatgacaaatttc

SEQ ID NO: 137101 - DNA, 1050 bp, Homo sapiens
tatgtgtttggctgataagtcacgtggtagttgtttattttttttttggtaaaatatacataacataaaacttgccgttttatccatttttaactgtataatttaataacatttataatattcacaaagttttatggccatctccactatttccaaagattttttattgccccaaacagaaactcttccagttaagtagtaactccccatccacccttccttctagcccctaatagtctctaatctaccttctgactttatgaatttgcctattctagatcattcatataagtgaattcatataatatttgtcttttgtgtctggcttatttcatttggcataatgttttcaaggttcatccatgttgtatagcccatatatgaacttcattcctttctgtggctgaataatactgcagtgtgtgtgtgtgtgtgtgtgtgtgtgtacacgcacacacacacacacactccacatttatctgttcatcagttggtggacactcgggttatttccaccttttgaataatgctactatgaacactcacatagaggtatgtgttagagtccctgttttgttttccttccttctgtctgtccttccttccttccttccttccttccttccttccttccttccttccttcctttctttcttttttttttttttgacagagtttcactcttgttgcccaggccggagtgcaatggcgcaatctcggctcactgcaacttctgcctcccaggttcaagcagttctcctgcctcatcctcccaagtagctgggattacaggcatgtgccaccacgcccagctaattttgtatttttagtagagatggggtttcatcatgttagtcaggctggtctcgaactcctgacttcaggtgattcacccacctcggcctcccaaagtgctgggattacaggcatgagccactgtacctggccatttgttttcattccttttggctgtatacctaggagtggaattgctaggtcatatggtaattctatgtttgactttttgaggaaccaccaaactgttttcca

SEQ ID NO: 137102 - DNA, 1630 bp, Homo sapiens
cacaactttcatcataagataaatctaatgttcaactagagatctctcccgcgccttgaacttgcaaatttatgaatcaggggcaaaaaaaacccggataccgagcctggcctcccaccagctagagaacccaccaagttccaggaggggcggggccgagggcggtccgtgccacagctgtgggcggggttgtccgtgcttgcgccagagccggcccgccccgccgccaggggctgtcgcaggagccaggcgtggattggtatgtgggtatgtcggcctctcttcataggccgcgcaggattgctcgagaggctttgattggctcaacaggcgctgagcgttcattggctgcgctgggtcgtcagggcgacgaaaaaggggaaggggtgctgggcctggcgggcaaactaaggctgcggaccgttgggcggttccgcggggcgttgtccggagagctgcgaggccggggttcccagggttcacgccacactctaggaagtgcctgagctagtgagctggccaacgagctccgcgggctgggaccatgggctgcttcttctccaagagacggaaggctgacaaggagtcgcggcccgagaacgaggaggagcggccaaagcagtacagctgggatcagcgcgagaaggtaatgaaagtcgtgtagccgccgtctcagcctccctgagccgctccgccaggtcccttacggcccgggaccgctgagggggccgacccaactgctgccgcactctcttgaacgcggatagctgaagtcggggtgcacgacttttttggggagcggggacgtgaagtacagcgctagagaggccgcccagagggctgtggagctccggaaggagccttaggagtttgttgtcgtggtagacagactcccccgggagctttctctgactccgaaccctgccttgctctgacttcctgttggagatgatcgattcgagagagggaaagagccgagaacgccctgaatctcaaatcacctcgtttcacccaccggcagcgtcaagcggggttttgtccagtcgtcgagttacgtatatgggaccgattctcatctcttccggggcttaatgttctgtggctgttttctcttttgtctgccctccccggcaaatctctttggtgcctcatgatatatttcactgctgaattttctcaattaccaagtggactgtttaatgtacagctttactccccctcctcttccagttatccgaaagaaataatgaatatcgcatcagtcttggaatgtgtattaagactgtaaggtgaaaataagcggcataaaccaggcagtattttactgctggtttaaatgaatgaaaacgcccttatttttatttttgtatatagccagaaacgaaaaacctttgaaaacctccattagtcttacacaaaacacactcggtcatacatttcataatagttcctctttctacatagttctccatttgtgcttactaaactactttgatggacttatcaattatttctcccaaacaaaatgagagatttttcaaatgggtattatgaacagttaactctttgcttaaggcaacatatctttacccaagattactttataataaatgtattaacgttttggaat

SEQ ID NO: 137103 - DNA, 1439 bp, Homo sapiens
ctggtactctacaaagcttagtacattttttacttttataaattccaaataggctaaaagcctactgacaatattgacagtagcaatgatgatgtaggtgtcacttgggttaagtcatgggaaaactcaaaccatagtgtcacagaggctaccctttagctttgcatgcccagaacacaatttaatagcaaagagaggggatctgtcttctgggaggtgtgtatgttgactaagatcataggttttatattattattgagagaaacaatttgtcctgttcattttgttactgtgtttcaaagtcattgagattaagaatttatatttcagcactaagaactgtgcctggcagccaatagtcctttagttgatacttgttgaataatgttaataatactcaaggtctgtgttttgttcctgcaggttgatccaaaagactacatgttcagtggactgaaggatgaaacagtaggtcgcttacctgggacggtagcaggacaacagtttctcattcaagactgtgagaactgtaacatctatatttttgatcactctgctacagttaccattgatgactgtactaactgcataatttttctgggacccgtgaaaggcagcgtgtttttccggaattgcagagattgcaagtgcacattagcctgccaacaatttcgtgtgcgagattgtagaaagctggaagtctttttgtgttgtgccactcaacccatcattgagtcttcctcaaatatcaaatttggatgttttcaatggtactatcctgaattagctttccagttcaaagatgcagggctaagtatcttcaacaatacatggagtaacattcatgactttacacctgtgtcaggagaactcaactggagccttcttccagaagatgctgtggttcaggactatgttcctatacctactaccgaagagctcaaagctgttcgtgtttccacagaagccaatagaagcattgttccaatatcccggggtcagagacagaagagcagcgatgaatcatgcttagtggtattatttgctggtgattacactattgcaaatgccagaaaactaattgatgaggtaaggagaaagagaagagaaatagtcatacacctagatttaaaaatgtaccactctggagtacttccattcttttcaaattggctattggaaatacaggcaaccctcaagttatagtcctttgccaccaccccctctcccaacagactcatctgtaagtagattgcttgggcctcaaaatactttctcaaagaaacttttaaaaaatataattcaattcagtaagcattaagcatttgtttgtaagtagattgcttgggcctcaaaatactttcccaaagaaactttaaaaaaatataattcaaatcagtaagcattaagcacctattatgtgctagttactgttatca

SEQ ID NO: 137104 - DNA, 1020 bp, Homo sapiens
ttatgtataaaaatattataataaactgcaaaaatctgtatgcaaatgttagaggaatgttaggataataagtaatgctgggtgtaactcagctggtaagtattaatgcagtatttgataatacttctgtggttactgtagtggtagcaaggacttgctgtgacccactgcatgaatctaccccagaatatatgtaggaaattctgacctggcccctttgatgcaaccattttgacatgggaacatttggaagcttgaaaatgaatgtttaacttcttagcagcttttggaaattgaatcaggtaataagtgtattggacatcctaaagtgtgagagttaggaataaagtgagcatatcggtagagctaaattaatgatttatgtacctgtgtgatgttagtgaagtcgtattgtagaattgctccaacccaaatataatatctgcatttaagtaacagaacattccacatggaagaagtaaaatgttctattgctgcaaaaagtagaactaaaaccaataagcagatgttgcaggaatttcagcaaataaatattatataaacaagtcttaaaaacaagagatgcctataggaagtattcaaagactgatgagttcatatcaaaagatcttaggagccagcttgaaggagtttccatgggccaaatttgggacaatttaacaattaaaaggaatactgggactggatgtagtgccgaacccctgtaatcccagcattttgggagggtgaagtggaaggattgcttaaggccaggagtttgaaacccatctgggcaacgttgcaagaccttgtcactacaaaaaatacaaaaattagctaggggtgatgcatacctgtagtcccagctactcaggagctgaggtgggagggttgcttgagcccaggagcttgaggctgcagtgagttatgctcatgccactgcactgcagcctgggcaacagagcaagaccttgtctcaaaaaaagagaagaatgaaggtaatgatttaacaacagaaat

SEQ ID NO: 137105 - DNA, 2256 bp, Homo sapiens
ctgtctcaaaaataaataaaataaaataaaaaataataatatatctttagcagctttgaaagggataatctcaagttttgctgctcagactactgagattattattagaaaatagaagaaacaaagagttttttaagtgactcttattcagtagcttccgtaatattgagtgttgtaaaagtccagatgtaataaaatacaactcaagtattatgaaagcagagaccttaattatataagtgcttccaaaagagcttaatttacattatagctattcaaagtgtattacatgaattctaaagaaaatctacagattaaatattgtcattataaatgatgtacttgaacttcttttgaataattagcttggaactttgttctgtggagaacatgggctttggcattctgaagtacttggtactgatttttttttttaattttctatttaaaatagatgtttgtatctgaaagcaaggagacggcatctggagatgtagacagcttctacaactttgctgatatacagatgggaatatgaagtgcaatgtggaaccaggacttggtattaagcctttcccaacttgtgaatatagaatttgataatacacttttgtgtattagcaatggtttttactaatgctaaaacttttaaagtttattttttaataaattgttgagtattacatcatttacttgaggttcaaaaataattcattttaaattaagtagttttaatcagcttaaaagctatttaacccattttaataagcttgcagttttgtttctctgcatatgatattcttattagaaaacagaagtagctaaaagtttattattttaatcctatttaaatgttctttcaaatctctaataatttaaactttcctcagtgctccatgatactttttttgagactccatatcattgcttattttacctttttcaatttagagggatttgttactagtcgatcaattagaatgaacctatgcacatttttatgtacacatatccagttatataattgcttcctagttgcattatatggcaaatgagattttgtacatggagttgacataatactttgtaaattgaattttttaaagaaataggcatttgataaccagcttggcaagtaactctactaacagatgttggtatagctatttaaagactacttcgtaagtagtatgattatttgaataaattacacattgtttagttttttaatacaactgctatatgactcttctgcttcctgataagaaaaggtatatgcaatgctaaaactgtagaagcccaatcaccagcagtttttaaaaaggtgataacttttattagctcttgtgggctatcaagagaattggaacaaaaccttgtgacttttaggtaagaaataggcatgatgataagctatgcagattattaaaaagcttgatacatttgatttttcattagatatgccattcatatcaagtaatgttcaagtatgataaaattattttggttgctttaaagcactgtttcccaaatctacctgatcataataatttaccaggaagcagaggagagctacttgtttaaaaatccacattcttggacccaatcctcagatgcacggattcagtcttcaggggaaactctgttttaaggggtatgttgtaatctaaagtaattggttcaggaggtgtcaataggttgaacttgtgagaaggcactgaatctgccatccacatcacatatagcagctattatgaaatcagctttcataggcctatttttaaaaggaatctgaaatttaattctattttgataaaactaagactgaaaataaccacttgtaaacattcctatgattgttactaaaatgtattttcatgtttaaaatgtttttggatatttttgggttaataactactacattgaattgcatgttaaggtgcagaaataatacattaaaagattttcactttaaattaattagtaatattgagcgctcaccctgtgcgtggccttgtgctaaccattagcactgcatcatttcaattcttttataagggcattcaatactacaaaatcaacatgatttcataaggtgcaaataaaagttggtgacagatttaatataattttgatcacaatttacaaatgatctttgcaaatagtggtcagacggcattagtttttcccttagttaagctaaattaaagggactccatcctgttatgattatattattattattattattattat

SEQ ID NO: 137106 - DNA, 1030 bp, Homo sapiens
agaggtttcaatgggtggctgcagccctatatattctttccttcaagtacatgaacccttctcaccacagattcaactgtcactacagagcacagccattcatctgactgccattcctcaatctgccaactctctaccaaatatgctcacttgaatagttaaataattgttctcctcgtctcaccatgtactaaattcaactcattatatttctctttcccagatggtctccctgtcctggcatttccatttccatcgatgacatgcagttatcttagttataccattgacattttggggtcattttagcttgttcttttttccactctgctaagcagctgttaactagccttgttgttgaaatgtttttcttctccatcctctccttttcatgtccctcatcatcaacctaatgaccccatggttacttacatcagcctcctgattggggtcctcacttgggatcttttcatcctgtacatcctatacactgcagggtaaaagagcatagtagttaagagcatagcccctggggctgttatcaccagtcttatatcatcttgtgacactttctattttggaactcttaaataatttaaaaatctccctagctagattgtcagctttctgagtaatccaaatgatgagtaccttcactttgagaaaggagagcactttctttctttctttcttttttttttttttttttttttttgagatggagtttcactcttgttgcccaggctggagtgcaatggcgtgatctcggctcactgcaacctctgcctcccggattcaagtgattctcttgcctcagcctcccgagtagctgggattacaggtgcctgccaccacgcctggctaatttttttgtatttttagtagagatggggtttcaccatgttggccaggctggtcttgaactccagacctcatataatccacccacctcggcctcccaaagtgctgggattacaggcatgagccactgcgcccagccagcactttcttaaaggacaaaaaaaatggc

SEQ ID NO: 137107 - DNA, 1055 bp, Homo sapiens
tacattaataccactaaatcagtaacttattgaaatgagctgaacactgtaggatgggggtaggagggtgaagagaaccgttagcaggttaccaaaaaaggaataacatgctggttctcatgtaacacaaaggcttgagggaggcaacccacagtgggttagaaagtgggttagtgggatagaaaggtcctgggctctgtcttccttcctggccatcctaatcatgtagttttttctatttgctggtaagatagctctcatacctggttctcatgtaacacaaaggcttgagggaggcaacccacagtgggttagaaagtgggttagtgcgatagaaaggtcctgggctctttctgtcttccttcctggccatcctaatcatgtagttttttctatttgctggtaagatagctctcatacctcttaagtattgtgactgcattctaggcagaaagaataaagagagtggcaaaaggccagctaagtctgtcccctttcatcaggaaaacaataactttcccagaagcctcatgcagtagacttctgcttagatctcatttgccagagctggatcacatgtccattctggcttcaagggagtctgaggaattatttttactaggcacattgttttgctgaaaaattgaagttctgaaagtaaaggtgaaaagagtggctattgggtaagcaactatcagtatttgccacacgaagcatgcattatctgtttagtttaaaatacaccatagggtcctttccgctcggagacctctctttctatagacagagagctgtttctctttctcttgtcttctgcctattaaacctccactcctaaactccttgtgtgtgtccgtgtcctaaattttcctgtcgcgtgacaatgaaccccagggtatataccccagacaacgtagtcacttcataatggggacctcatccgagataccaaggtgcaacattcaccgaaacgatgaatagatgaggggactccaactctgtcctttcatttcgaggctcttggcttccattttagaaccaaatcaaaccaaata

SEQ ID NO: 137108 - DNA, 1023 bp, Homo sapiens
attctctctaagtactccttggtctctgataccccatacctgactatctccactggacaaaataggttcttgagtcaagcactaagtaaggaatatgaagatttcataatttgtgtgcagtttcagataaattctttccaaagttaggagaagtaagaataaaatatgtaactggaatcagttgctacctaaagatgtctttttttaaacctcaccatggtacctggggttagaagcaatgctttgtttactctttttaaaaagcaacagaatgggaatattgtagtaaatctctgggggaattcctgtcttcacaccaaaaatagttgttattctcttagttggtttggttttatctcatggacattttgaagtatatattttttcttatttttttccaatttttgagccacatacattttatagactactattcatttttaatctgtttccttttttctttttcactttctccttttctctcctactcttttttattttccttctttactttctcttttttcctgccaattttagtttttatctttgtgctgtatttaattgtatcatcacaggccacattaaatcatttctggaagatcagttttaaataaatagatgaataaaaaaatagcagttaaaaaaagggagagaaaagatttaagaacatttctaaaagtaaccccaaaatttcttcagggggataaaaagtgggatgatttgggaggtcgaggtgagaggattagctgagaccaggagtttgagaccagcttggacaagacggcaagatcctgtctctacaaaaaaaaaaaaaaaaaaaaaaaaatttaattagctgggcataatggcatgtacctatagtcctagctacttgggaggctgaggcaggaagatcacttgagcccaggagttcaaggttacagtaagctatgatcacaccactgcactccagcctaggcgaccctgtctcaaaaacaaaaatgaaacagtggaatgaaatcatttgggtaatgtctcccagac

SEQ ID NO: 137109 - DNA, 3228 bp, Homo sapiens
tgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggtaggcgccgcggaggccggacccggcgcgggcgaggttgggggcgtcgcaccggctgggcggcgggagcggcggcctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggtaaagtgcctggtggcccctctgcccgcccgggtagtgcctggtggcccgggcggggggcgggggcggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggtgggaaaatcgtgagggctttgctagtcttccggggaaattttcccaccgctgggcacggcaaagttaacttttctccagctttcgagttcgttttattccctccgccccgggggccgtagtttgtttttttgttttgttttgttttgttttttgtttgtttgttgttttttttaatagccttcaatctttttctcccgcttttcacagcagagccagtgcttcggtggagtctagctttaaattgcacagggcagcctgagtttgttatttgtgaggagggggtggcgggatctggagtgagtgaccacaatggtggtatgtggaggcatgtttcaaagtttttatcgctgtgcggccctgggacatatgtggctactagggatttggcaagaaacttgtttggccgcttctccgactttgagttgcaaggaaatccgtggcctcagatgtgcgcgagttgtttgtgtgtgtgtgccgtgaggtgcgtttatctatgaagctgaggatgagattcccccctcccgccgtctgattgtgtaagaagtcaaaaccgtgttgaaggtgattccagtggtggcctggagggaaaggcgacctcattccctgtgttcagtctgataaagtgaactgctgctctctaaacttgggaagtaatgaaaaataatttaggtaaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggtagaaaaaagtagagaaaggcttcccactcctccctgaagtgttgtgacccaccttcaggcccgtaggggagattcccaggagcaggacaggtgatggtgcagggctggcatcatagctaagaagtatggattggtgaaagttaaagaagaaagggtgttgaagacttgtaggtttagtattgtcctctcctttaataatgcttgtcttttccctctcttgtgttccaccaaccataacaacccattttttcccctaacctacacaaagccatatcttctttctgcccactgctttgaggtctggctggaactaggcaagtattttggaagaggtgggggaggtaggaggcatcaggtgctggtaaagacatggcattagggagggctcttacaagccttgatcagagttacagagagccagtccaaaaatgaagctgagcattatcaggggacataatgcacctacctccttgtggagcttacacaaaataggagctgagaagacagaggtaatatgctgtcttacattaagaaaatctctcattgaggtatgatttactatgatcttgacttgtcccacaatataggtgagaagtgagtgttaggtgacacctgtctggcactctcctaacatggggacactttaatggctcacaagtttctgttgttccagttacagtggctgggaaagctgaaacattctggtttgtatggtggggaggatctagggtgaatgggtaaaagtgatgaacaaataaacgggtactagcaagtaagtggtcattacaaaccaaataactaccactttgagttttctgatttctggaatctttatgactccctcatggttatttttgccttgttcctgtaggtctttccatagataataacaacaaaattcttaccattag

SEQ ID NO: 137110 - DNA, 1074 bp, Homo sapiens
tccttttcccttggtattggctgatgggcaaggaaacccaagcctagaatgtgtttttttgttttgttttgttttgttttgttttgagacacatgacaagaatatatgataccagcatggccaatacactagactttgtgtgttggaatcttctgggacacattcttttttaaattttaaaaacttattttgataattacaaactgttataagaatagtacaaagaactcactatattcccaattagtaacggtttgctctcatttgctttatcacttgctcttttagttctctttccaaaccatttgttagtaatcactgaaatttattatttgttgtttctttcaagccatttgttagtaatcactgagagattggtacttatcaagggcatcctgtcctgaacagtggctcagttgcagccactgggtatagcagaacagtggtggtgaggcagggtccagaggtagagcaaagtctacctacagctgtgaagcacacagtttgtaaaccgtgtagaatctctagggctagatatagaaatcattatcgattgtaaaagtggttaagataaactccacttttctcaccattcttgtcaagtttgttcttaactatgccaaactttaatactgttaatgaaaattcactccactccccaactttgcaacaataatatattctccaagattttcatttaattcattcagcaaacatgtattaaataccttctgtttgctaggggtataagaggtgaaagatacccccttaacagctcaacttccagtggaaaggaattaagtcatcttctcacagtcaggaggaagagtgctctgctgaaggggttcacagggagtgatgggagcaccatcctggttaaggatctgagaagtagatctctgggagtcatttgggatgggtgtaactatgaagatctgtcttctctgaggcctgctcttagatgacaaggttcatgagttagagaagcctttggtgtcatatacccagcacaggctgtgaggtcaggccaacttggattcaaatcctaactctaccacttgctcttggccagtt

SEQ ID NO: 137111 - DNA, 1041 bp, Homo sapiens
ggacatagatattcttgtgagtggcttaactgctttctgatcttgtgtggctattatcaaaggagtctctagatttcctcaaccttccattcaagcattatcacgaaaaccctagtgtattagactctactagattttgtggtcaagccaaaagaccgttatttgggaaccaccaccacttaagagatgaaagaaacatttgcagtctttccttggaacctttatatgatttataatttgtacctaagagaggaaatccgtatttgagcattggtaataaggacaagggattctctgtaaatgtgttttaattggttaagatttaaaaatcttcctgtggttgcagtgaaaaatccagcattgtactgtgaagtgagtggccaggaattaccaatttggggcatcagcctttgacctttgcttgtgaagatctcagaagtaacactttccacataactgaaataggcttcacaacagcttgtggcctgaaatatattacatgaaaatgcaactggaccccaggaagtatgtgtgggaaactatacaaggctcattttgtatgtcttagagatgtacattcccccagaaaattgcctggtggtagaatgttagcttttcttctttcctcctaggataaaaattaaaaatctctgacattttaaaagtcagtgacttgaaagagcaatcaaaatttataaacacacacatcattagaccccacaaacacttccaggaatttattcaacaaatatttgcatattaattggagtattgcttgtagtagcaaaagattggtaatatcctaagggtcaatcaagaatattgaagacactgatagttttggaacacgcatgaccaagcaggtagagggtgagagggagacttttcactacataaacttttacgtatgtgttttgaattttaagcaatgtgaatatattttcttattttaaaagttaaatacattttttaaagagatgatatatagtgatgcaaaattccatagactcctatccgagttgacctgatcagagctattcc

SEQ ID NO: 137112 - DNA, 1051 bp, Homo sapiens
caaagtgctgagattacaggcatgagccaccacgtctggctttttttgctttttaagagacagggtcttgctctgtcacctaggctagagtgcagtggccccatcatagctcactgcagccttgaactcctgggctcaagtgatcctcctgcctcagcgtcttgagtagatggggctatgggcacatgccactatgcccacctatttttaaatattttttgtgcagagataaggtcttgctatgttccccgggctggtcttgaactcctgcctcaagtgatcctcctgctttggcttcccaaagtgttggaattacaggcgtcagccactgcacctggcctggcttttttcttctttttcagagttgtagtggtgagagaggacatccttaacttgttccaatcttggaaagcattccatctctcaccatcaagtatgatgttgtaggatttttttttaatatactgtgttgtgcagaaaagagttaacatagcagacctgaggctgctgtctttagaaggccaacgtgcacgattggcccttagctggtgtttgggaaattggcttttcaaatgtttaaaaagaaaagattatattctaccttcatttattccttttccaatgcttttcatttctttatggtaatccaggtttcctaccttgatcacagtctttctgcttaaagaatcccctttaacctatcttttgagggcagatctgctggcagtaaattctctgtttttggttgtctgagaaagttttcattttccttcacttttgaaaggacacttttgtgggttgacagttgtttttcctctttcaacatagtactccaccattgcctggcttacgtgatttctgatgagaaggctgctgtaatccttttttttttttttaataccttaagttctgggatacatgtacagaatgtgcaggtctgccacataggtatatatgtgtcatggtggcccgctgcacccatcaacccgtcacccacttcaggcacctctcccaatgctatccctcccccagtcccccatcccccaacaga

SEQ ID NO: 137113 - DNA, 1051 bp, Homo sapiens
ggttctgattcttgtactaattttattagttttttaaatgacagctttgagatataatttgtataccatgcagcttacccacttaaagtatacaattcagttattttaatatattcacagatatgtgcaaccaatcaccaaaggacacaatatgttttcacactgtcttctaattttgtttctgagaaattagctgttaattttattggagttctcttgtaagtgatgagttgttttttttcccgggctgctttcaagattttctccttgtctttggctttcagtaattttactatgaggaatctctttctggatctctttgcatttatcctacttggagttctttgagtttcctgaatatgtaaattaatgtttttcagtaaatttggggagtttttctaatattttttctgctcctttctcattcacttttccttttggtactcccattatgtatatgttgatgaacttaatgatgttctacatttctctgaggctgtttcttcttcttttttccatctgttcttcaacttgcctaatcactgttgacctacttcaagttcattaattcttttttctgcttgttcaatctactgttgaggcccttcagtgaatttttcatttcaattgtgctttcatcaccagaatttctatttggttattttttatacttcctatttctttattgatagtctctgttttgtaaaatattgtcatcataccttcctttacttctttaatcatggttttctttagttcttcgaacatatttatatggctaatttgaaggttttgcctgttaaatctgacatgtggttgtatgggtcatactttcctgtttctttgcatatctcttaagtttttgttggaaactgggcattttggataatatattgtaacaattgtgggtactacccctccaccagggttctttattattatttgcttgtttactgctttagtaactgcctggattattttattgaagtctatttcctcaacccccattctcaccctgcagtatgaagcctctaatgttgctcttcggggg

SEQ ID NO: 137114 - DNA, 1035 bp, Homo sapiens
atcccatgagttgggggctaggtggaagaagggagcccccacctctcagccacattctcctggaacgtagcctcagcaaaagtagctgggaacgggataagagatgccgacatcctgttcttcccaggaagaaaggagcttggagctggggtagaaggaaccctgtgttcttggctactgtactctggcatgagatctttgctgggagggaagatggaggaagtggttctagatccaaatactgcagactttgactttactttatgaattttagtagattttctcgaataagtacttcatttgctgtatgcccttaaaaccatttccagagactttaaatggttgggttttttttaattgaaataactttcaccaattttgctgggaagagggtcgtccatggagctgctcacactgttatgccagaagtggaactctgtgagctttttaatgtaaaattttgttgctgctattcttaattgctcagagtggccttgtatttggatttctacctcctcagtagattgtaaatagcttgaaggcagtagccctgacctttattcattatggaatcatgatagcccctggtagcatgttgtatgttgtggcacataaaagaatgtcagtcactggctatattgctgtcttttcaagtttacattttcagcacttcgtttgtgacttaaagtgcttaactgtgtcttccttttttcttacactccagtgctagtgtgttcccagaagggtgatgcttcttttttatctgtcattggccatactcagggaagtacacttgaaccgttggaagttttagtccaaagcatttttatttacccttcacaatataggagctttgtttaacattccttgtagtgtatatataattttgactttaggctacttatttgggatatggggacaggaagagagtgagagagggataaagggcaggcagaaaatcagtgtggtcgtgttcttaaaggtggatgtgcctcacttgttctttcttcagccaactatgtctcatgcttttca

SEQ ID NO: 137115 - DNA, 1033 bp, Homo sapiens
gctgccccaccctttgttttggtggacagtggccatgtggccacatctgaggctccagttagtgctgtaccactcatttgtggcttgggcttcctcctaaggctaatgtggcctttcttagtctttgacatgctttgtattgaaagatctggtagtactcttctgtcattattctaagtcatttgagaatattcttgacaaaaatcattcagtttgtatgatttgcttgctgctatttctgggatccatgggacagtgttgactgccctctgggatgggtgtgtgtgaactgttttattcagtgtttttctttttcccaggatgctccaggatgaaacgccataggcctgtcagcagcagtgacagttcagacgaaagtgagtagaaccggctggcagctggtaacctttctatctatatcccttgaggatttttcctttcatttgaggataaaccatttcatgcttttttcaatggttgaaaaatgtttctgagaaggaaaattcagggcaccattatcttatttaaatttcattagagatagataaattagaagaattgattgtgtgtggcatataacttttcacttttcatttacctaaataacaaaagccagatctagtaatgctttaacagagcttctctagaaagaagaaaagtacaagagcataaattgtaggccctgattctaattgtagcttaggtactaagtgtttgactgtgagtcaatcatcatttgtaaaaggcagtaaccttattagcaatagcctttggggaagtgctgaaggatacacagattacttgctccacatttgtagtttttccagttgtttttggagatactttttcttcaagtggaatatgaattgtgttattgcagaacattatgaggtgtgattataccaaatcagataatctcatccttagcattgttgaagcttttgcactgtaggagatcatctataaatgtcactaaactccattatgaggcactcttcagtgcagtttgactgttttcttcagtggtatgagc

SEQ ID NO: 137116 - DNA, 1092 bp, Homo sapiens
gaagtataatatccacacagaaaagtacacaaagctgtacagctgaatgaattttcacaaattaaatgcactcatttatctgccacccagatggggaaataaaacatggctgggcacggtggctcatgcctgtaataccagcactttgcaaggccaagatgggagtatcacttgagcccaggagttcaagactagcctgggcaacacagtgagaccccatctctacaaaagattttaaaactagccatcgtggtggtgtgtacctgtagtttcagctacttaggaggctgaggtggcaggatcacttgagcccaggaggttgaggctgcaggagctttggtcatgccactgagaactacctaaaaaaaaaaaagaaaatattaccaacacccaagaacccctccttcttctccctgccagtaactgacctccctcacccaaggtatcagttttgccagtttttgagcttcctatgaatagactcctacagtgtagtcatttgagactgaattgttttgctcatcagtaggattttgccatccatccatcctgttgcatgtagtaattcattaattttcacttctgtgtcatgcattgtgtgaatatgccacattttttattctgctcttgatatatatttgggttgtttccagtttttacctaccataaaaatgctgatatgagcctttttatttatcatttggcatgcatctgtgtacacttttgctaagtatatacctagtgtgggtttgctaggtcatgggtatgtgtacgttcagctataatatctgctgccaaagtggttgttcaaattcacactcccaccagcagcataagagataatctatttgctccatttccttaccaacatttagtattttcaatttttggacagtctttttaagtttaattattctggtagataatagtgattgtaatttcagtttgcatttccgtgataactaatgaggttgagaaccttttaaaagtttatttgccatctggatagccttacttgtgaagtatctctttaagtttttttgcccagcttttaattgggttgtctttttctaattaatttgtaagagttta

SEQ ID NO: 137117 - DNA, 1064 bp, Homo sapiens
tatgggatctggctgtgcctttgtgcagatatcgccccctcccaggttggtttcctcttctaaataaacttggtggccattgtaccaagaacacactaatgtgacgacattttattagaatgaatgggccagtcgtggtggctcacgccagtaatcccaacactttaggaggccaagttagaaggattgcttaaggccaggaattcaagaccagcctggacaacatagtgagaccccatctcttacccaaaaaaaaatttttcaaacgttagccaggcatggtggcatgtgcctgtagtctcagctacttgagaagctgaggcaggaggatcactggagcccaggagttcaaggctatggtaagctatgaccttgccactgcattccagcctgggtggttgagcaagagcttgtctctaaaaatttttttaaaaattagaatgttgggaaccaggatccatgagggtgaataaagaatattgtaagcagtcagtgagttaacagcacatgacaaaactaaatttgtaaaaccatttgctttctagaaaggaatctgccatacctcccagagggcatttagccatccattcagtgcctgaaatctgtcatttgttgattgttatcattgtctttctgttgcttttctaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggtaagttcttttctcacaagtaagttgtgacttaattcatgttttttttttaagttatcagaaccctttagcttgtttttatttttgttgcctcctttcttttctggccttttcatttatttttctcattgattttatcttatttcagtgagatatttcttcaaatgcatacatagaaataaagcaataatatttaaatatgaccttttctttcctcattcatag

SEQ ID NO: 137118 - DNA, 1139 bp, Homo sapiens
ctaacttgctaagaatgaattattatatccaaatagttatgtgattttaattactatgctacaaattatcgtgtccagaattataaagcttggtgaaagtcctcctacagtgagaataagagaaaatatagagatttaagaggagactggcaaggatttggacaagaaatcgaaagggtcagtaatatatcttctaaggaacatggtgaaatatacatctcctttcatgtgtcaaacactaatatatgattataggtaaatgttagagtagcactagcaaaagattttttgaaatctggttgttttagagcaggaaagagatgtttttatcctttagaatcctacccactcctgcactgggctcacagtaggtgttttgggaatgacagctgactgatgggttgattgattgtttgtatttctgtgcaggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggttagtgagagtggagaccgtcatctccctacggtcagcctttctgaagctcagtgatgatctccagcacgcatatctgggtagcagcttgcatttaagggtgaaaataaagatttggcctggttgttcttcagtatttcctctagaaacaatgcttcttatgacccccaagatgacttgctgactaactttaccccatggggctaaacccaggtctttattgtgtcactttatgcccagaccattgggattgccttgttcagcttgcccctaggcccctgccccagggggatctcattgctgcctgtctgaggtctctcctcttccttcaaatctccatggcctcatgaggttacacccatggtcagtaaccttggtgagtttacacttcctacaaatagaagtccagactccttatcctggcacttgtaaccctcccccatcccctaaacatgccactcctaagaatgtccaccccacttttaaagatcacagaat

SEQ ID NO: 137119 - DNA, 1076 bp, Homo sapiens
cagcagatgaaagaaagtgagtaatacaagtctaggaatttggatctggaagataggaagtatggtggtgacacggaaagaaggagcttggaaaaggaccaggttgtggggggaccgatattatggtaactgttataacttgaatctgagttgagggtgaatctcctgaggcagacagaaattttgaagctgccatattgaatcagttagtctctaatagagtagagcagtaaggaggaaatgatgggcaaaattggggatagcaaaaagggagtctagaatgtttcccaaactaatctccagtttctcacagtaattatttgtccaacttcattccataaaggatttgaagcaccttccagaactcattatgaattattgtgattagtgtaatattctattcaagattcattcacaagtccctgtttcttcaacccaagcaagcaattgctacgatttactgagtactttttatgcaccaggcgttaataggctttttataaacgtcagttcatttgctcctcagaagtttcattctctttattttctaaaacttttttcttgatcacaacagtgtatgacttttaggaaatgttcaataagtgtttgactaattataatacatagtcattgaagaagctttagaaaacagaccaaaaaatgctgtaatcacaacactcagataacagttgggttaacggttggctgtatctcctcgtcttgttctatcatccttaaagtcagttctcatggacagacatgctgatcttaggagagatgctggaagttgcttttttgagtatttttaaatcactcgatactggatataagcttgttcggctttatttgcctttctcccaaaagcagaggatactctgtgactgtgtatcagaacagataccaaccctggtgagaaggtgctgaccattctcccctctcctcctcatacctccaggcctgctatggcatcctcaaggtcccagaaggcagctggctgtgtcgctcctgtgtcctgggcatttatccgcaatgtgtgttatgtccaaagaaaggtggagccctgaagaccaccaaga

SEQ ID NO: 137120 - DNA, 1030 bp, Homo sapiens
ccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtct

SEQ ID NO: 137121 - DNA, 1057 bp, Homo sapiens
tttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacat

SEQ ID NO: 137122 - DNA, 1107 bp, Homo sapiens
gcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaaggtgagaggcgggggggggggggggggtagtggggacggaaccccgaaggggtcagtccgggatcggcagatggggcgctgtagaggacgttcttaggcagtagaggactgcgcggccggcgaaagcctagaagacttgggaattttgcctaccttgtgttcctcctttgtctctcggtatcttcgttcca

SEQ ID NO: 137123 - DNA, 1071 bp, Homo sapiens
cattgccccttcttttggggagtttgtatctgtgacactgacgctcatccatggaaaggggacccactgtgtaattgtggtccttactgtgtgttccttctgtgatgtgggcccgtagttatttggggctcgtgtctgtgactggcccttggctgtggtggatgttactgtgtgactctggcccctttgccagagtctcttgaaggtttttgtgctctcagacgccagtgcctctgtgtgattctaactcttgcccacctgggagcaggtaactcgggttccctgtggcttgaggaggaagagaaaattggagtgtgtttgtctgtgtatgtgtgtgcacgagcatagagcaaaggtgtggcagcaacctagtgttgagcaggtgctattattgcctggctttacctgcttcttattcagagggtggggcctgaagatctgggattcatcctgacctctggctgggtcacagggttctcaggactccctgagttctcaccacagccctgagggttggatgaagtggctgctgctccatcccaatagaagagcacagtggttcagaacagcctccaaaagggccccttttgcctctggaaaccgggcttgagccctggggagggaaccaccttaggaccgggctgcacataagagacagggctcagggctgagccagttgctgtgtgagggccaaggctgtgttggccaggagcccagggaggtggcagctgtctcgtcgccaagttcgccccttcacacacccccccaagagcctttcatggtcttttgctgccttataggggacagccagcagcttgttgggaggatgagatggtcccttggggcctgtggaaggagcctggggcccccattgttgtgaagtcttgtctgatgtgctgaatctcaggcaagactttcagccctgagagtcccctacccccaccctgggatgcagccccaggcttgaatttgtctacctgtcttaggtggcaaagccctgatcacactgtgggtggccccgccaggtctctctgcaagatgccccctgtctgctgaagtccttgctgtttt

SEQ ID NO: 137124 - DNA, 1893 bp, Homo sapiens
gggctaccttcatactgtgatgcacaggagtgctgggagctggaagacaatgtccctgggctaaggggcagcggagagccttgacaataagagtttctcaaggaggccctctcagtcccaacagttttgacccctttcttccctccactctccccagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacggtgagttatctgttctcagcttcccagacagcctaggcttgcgtctatgtgagaattgatccaagaaggtgctaggatggggcttctgggtagaggaaacagcatagcagatgatgggtttcttttcagcagacaggtgtttggcacctgttgtgagccaggacctgtgctaggctctgatagtgcagtgatgaatgagacatgagattgcatccttctcagtactcagggtgtcacagggacgctatgcagttaacgggtgggaggttgaggttggggctatagcctggggtatgagggatgggtgggaatggcaccatcagagtcaggatttgcccgggaccactaggggacaagccaggtcagatagtggaagactccagggacagtatgggctacagttggcatgatacttgctgggaatggatactctcagacagttatttcttcagctctgctatgaacaaggaatagctggaacactgggtaaaatacagaaatcctgagtaaaattcagtgatccctcgccatccaggtgattccgaggcaggtgacccagccatgacacttgaagattgcctagaaaagcagacctaactctctcagaaagcctctattaagactcaagagtcaatagctttataaaaagagaaaataatttttaaaatgttttacgaagtgtttcttctaccaccactccttttaaaaatgtagaattgtaatattttgttttctgaaaagtgagcccaaatttgagataaggtcatcacctagtgttattcagtcttggctttcattagaaatgttttttgaaagacatttgattttggacggtattcactagaagtgctctgtggccatttctgaatttgagtagctgacatacatactttgttcaaactttattaccaagtaaaaccattgacttttaaaagccctcaagtgcagaggtttgagttcatcatactttccagttcaaggtaggtttctgtcataggtcagcaaaaggcttcctcttgtcatgtttattttttcatttttattcccaattcccacctctgtgggcagctgctctgtcgtgtttgatatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatcatagatttatcatatagatcattttcatataaatgtatcatatagatacatgtatcatataaatacatacataaatgtatcatatagatacattttcatagaaaatgaaaatatgaagtgttgttttg

SEQ ID NO: 137125 - DNA, 1167 bp, Homo sapiens
ttgccttagaaagcactcacatttgggatttgggatgtagagactgaactggggaggtccaggtagaagtgaggagaacagccaggccacaaccaaggtgccccatgagggaagccagtggcatggaccagagagtgacatagggatggagagaggcaggttgcacttcagagatgtggagcagggatttaggaatccctgtatgggggcgggcctgagggcttccaaagaatagagtagggggagggaaaaatagaaagtttacagggtgagaaacctggcagacactgccttaaccagatgaccatggttaacatcaccagagctaagtcatggtggtatcatgtacttctttctctgataggatcagaagggcacctcacttctgttgtatgctcctccaaaaaaaccaaaaccctacgagaacacatcacctgggcctcttgcaccttttagaaagggcaaccttctgatccctccccatccttcttcctccactagtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggtgaggagggggcgcgctgcgccaggcctggctgggatgggctcccaagggccctctgtgtctggctgcagcaccgtgtgcaggcagctctccactcccgtgccttcagactgtgctcggtggctttgcctcacctggagggcctgttcccactcccctctctgagggctcctctcccaacctgggtctccctggcttccacatgcttggctctgtacttctgagggcccctggccaccactctttccctttctccctgttgttcagttcgggcccatggctcactgtgaaccctgtactgcccgctcccagccaacttgggcacttgaagagcctcttccatgggacccggcgtctggggttgggaggacaacaaggggactgcagaccaccaagctgaggagctctgggaggccagccatgggcattcccagtggtgatagagcccctagacagaagggaaggacccttctggagaagcc

SEQ ID NO: 137126 - DNA, 1365 bp, Homo sapiens
atgtgttaggtatgattcagtccccatggcagcccagcagggaaggtactctttgtattccatccttcggatgaggaaaccaagccctgagtgggaatgtgacttgccccaggtctcatagccagtgagtggcagagcagagctggagtctgaacccgggcagctggaccctagagcccactttttgctgcttcctcagccttccctgagtttggagtcctgataagctcttctgtgtgtttttccttttcaccctgtgtatgggtgtgtgtaaggctaatgtcctgtctgttgtttaacctggtggggaaactgaggcccagagacatgaagactccttcccaagaatggctggcataggctcctggtcctcagtgagagacctcactggcctagagaccctgcctcacctgggccaaatcctgaattgcctctgcagtttccctctggcctactccatctgggaagcaatccccaggactacatctttttgctttttgtctccaccctaagttattgctacagtcatggtctagggcacatggctgggatttgctcagactcctgtcctccccagtttgacatttatgtcatggatctcttttgacgcaagctgcaggtcagcagggcaggggcgggggtgcgggttatccccttgccaagggcaagaattgcatcccaggtttccttacttcgtggctgccagcgagccctttgtcagatcaccctgcccaccgttcttaagtggctggctcacttgctctcttgttctctgtgcccctgagggtcgtcctgctgccatgctttaccttgctctgtgcccatttcttcatttgattcactttctgcaagtctggggctgaaagtcaagactgtgaactggtgtgggcctggggctgttgtcactcagggaaaagctgcgaaagaggcggaggagactgtgtgcacatcaccgatgacccctcgggatccagaggcctccagccagcctcaggtacccagcggccccattgtgctgagcctgccctactctgtatctccccgtatagatccgtggccagctgcagtcgcacggcgtgcaagcacgggaggttcggctgatgcggaacaaatcttcaggtgagcttttgttctagtgccctccccttcaagtggccagcctcagcctccgaatctccctcctgcctctgccttctcccccactccctccaccaccttcctgccacagctgggaatgggcagcgtggggggtgccctctcttctctcccactccccacactctcctcacagctccagccaaaagcctcttcaatggggctgtcggggcaggggtgcagctctgagctgagctgggtgctccctgg

SEQ ID NO: 137127 - DNA, 3185 bp, Homo sapiens
gggtggtggtggggggagttgtctctacaggacctctgcccaggctccccaaggcaggcacagtggggcctcactctgcctgggcttctctctccatctctcagtctctcctccccacacctccatctctctctctctctctctctctctctctctctctctctctctctttctccctctctctctttctctctctctgccccccccaactatattattcattccatcctcctatgcatcctaacggttattcttttgaacattaagcatgcccccccaagcccctctcatccaagccctccccatgtatctgcctctaaaggacatgctatcctgaggcctcaaccctgaatccctttcccaagcctggaatcttggttgcatgtaggtcttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctctcttcccagttggtgtgtgtgtctctccccctaccgacctctggcctctgtttttctccctccaccttccctgccccacctggccatctaccttgccccccacgcccgctagtctttctctctctgattgcctctttctctttcttcctttttcctcttcccctttccctctctgccccccgtcctctcccctcgggtcccgcccccgggaacgccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagtgtcagggccgagtgggggtttctccccactgtccggcaagcgtcggtcagccgaacactgtgtgcctggtggtgtgtgttcacatgtgtgcgtgcgtgtgcccggcagagcagcaaacagctgcgcccgagagctgtggcgctttccctccctacctcccttcttccctccatccgctctccgacctccctccgttccctgtccctcatccatccagctgaagggctcgctcactctcttctcctatgctgaaacggtgcgtggggcactgctgcctggacctcactgtgctctgctttttcccgcagcactccctcaacatcctgggccagaaggtgtcgatgcactacagtgaccccaagcccaagatcaatgaggactggctgtgcaataaggtacaggggcggtgggcagcagttgtcatggacagagacagcaacagcagtggcggcgatctctcccttcctctcccgctctttctccctccatctctccccctcccccaatctctcctctccctctgtctctctctctctctctctctctctctctcattctctatcccttgctagctcagcttgagtagtcaccattcctagccagccatatacaaatgtgtagtgagcgttcacttggtgcaggctctgtcctcctaaaatgcagtcttgcctggagttccagtagactttaaggaaatatatacgtggatgatgaattagtgacagtgtagacttgaagtggtggtgtggagaatgtgg

SEQ ID NO: 137128 - DNA, 1120 bp, Homo sapiens
tgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataagatcctccattacctaactggcttccttccccggccttggcttttgcttctccccttactctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcac

SEQ ID NO: 137129 - DNA, 1049 bp, Homo sapiens
gaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacaggtgaacaccagggtccagcagtcactggctggctgtgtggtgtcttccagcaacggcactctgtcagctcttgccctctcctgccaagggagatggcgggcaggtgtggatgtgggcagtgactgcttagcagaccatgctcttgccccagctctgctctttgctgaatggccttgagccagagcagtctcctcagtgtgtggcagggttgcccaactccaggaggtggcttgtgccatccgagtgagccctgtcaggtgtcttctgtcccatggtggggaccctcacattctgctggtgaatatacatgtatgccagagaaattctcacaggccataagggggtgggcaggaaaaaagccctgcaatgttttgtgggagtgggcagatggagggcacctcagtgtctctctgtggagaaagggtgtgacactgtgagcgtagcgtttacaagcaagcactaagtgttaccttagcaacctgatgaattctaaaaatggtgctgtgctggggggaacatggaaatatagaatgtggcattgtgtcatgcatataaagttatacacaaataaacattcctatgcatttttaaatgataaaatggaaatgcacaacaaatgtgacagcgtgggtgtatgtcaggggaagaggagtgtcttcatccatttgctgctccataacaataccacagactgggtaatttataaggaaaagagattgatttggctcacagttctgtaggcagggaagc

SEQ ID NO: 137130 - DNA, 1169 bp, Homo sapiens
cggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcagcaaatgaagtaccgggaccgtgcagctgaacgcagagaaaagtatggcatccccgagccgccagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaa

SEQ ID NO: 137131 - DNA, 1093 bp, Homo sapiens
acaggcatgcaccaccacgcctggctaattttttgtatttttagtagagatggggtttcaccatattgcccaggctggtctcgaactcctgacctcaggtgatccacctgcctcggcctcccaaagtgctgggattgcaggcgtgagccaccgcgcctggccatggccctcttgttttctactgcagtagaaaaccctcttctcagcatctaccttcagcgcctccatggggtcctacataattggtcagagaaacccaaccccatttggggacctagccagtgtttgcttattaacctttttaaggcctgcactatctgggcccagcttcccgtttccacaccctcagagcagctgtgatacctagcatgtcctgtcagagattgacacagggcctttgtgttccattagaaacctctcccagcccctcaccatccaccctcacagcctcctgggactctgtagtaggaatgtcagatacacctctcctcttgcatgtccctatctattatttttggttaaagatttctctctgctaccagcatctgtctccagagtcctccagagcctcaacatcctcctgatggaggctgcctctccccccagaccccaacatcttcctgctgcctcctcagactctagaatcccccacccattccctttgcagcttccatggggcccagcaactgtcctcctacctccttgcagccttgggggcctccactgcaatttttcagcctttctccaaaagatccttttccagagatccgaatttgagtcttttcctaataccctagcctagtcctttccctcccaggacttctaacatctcctttcccatttgtctcagagcctccttgctcttagacacccacttcctgattctcctctcacgttcccatggacttctcagttaacccctcccagaaagcttgacatgctccagccccccttctctatgccctagcttctccatcctgctaacctgcctcctctcacacctccaagactcctccctcaaaccctctggtttgggaatagagaatgcttacgcttgaaaatcttcagtttggagactcaggtatgtttagaa

SEQ ID NO: 137132 - DNA, 1953 bp, Homo sapiens
ctatctttttgcaacctcttttattggtctgtgtcggttttcccctcccaaagctgggggcagggttgggctttataaaacttgagcccctctggggactgggttctcagcaagttaccgctcctgccatcatgccaccctgatggatgtccaagcctcacttccctcctgcactccccgctcccgccgccatccctgggattaagggagaggagaatggctgcttgttactgcctacctactctgtgccaggttctatgctctgtgttatttatcatctcgataaccccgtggggaaggtaagtggtattatcacccctgtttcacaggtgagaaaactgaggcctgtggcggttaattattactgttagtgcgtggcaggctcaagatttgaaaccaggtctgtcctgaatccacatccttcccctgacctcgacacaagtacattcttgtcattcctttcactccaggattggagtctctccctcattatgctgggctgggaagaagcaaatggcttagtggtcagcagtgtggatttgcaaatcagaccacctgggttcagatcttaggtctgacagctgtgttaccctgggcaagtcctcacctttctgtgcctgtcccctctttgctgtaaaatgggggtactaatacttaagtcttcccttcccccacagttgctactaacaaacagaaaaacggtacccatgtgctccagggtcacctctgacctttttttcctccagatgtccagctcgccgctgtccaagaaacgtcgcgtgtccgggcctgatccaaagccgggttctaactgctcccctgcccagtccgtgttgtccgaagtgccctcggtgccaaccaacgtgagtgtcctctccgtggagactggcagacgaggtggtgggtgggaaagtcttttgtatcactgtctgtctatccatgctccactcctgtgtgtctccctaaacttgttcttttcctctattcctagggaatggccaagaacggcagtgaagcagacatagacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttacagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacccagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctcagcctcccgagtagctgggactacaggcgcctgccaccacgcccggctaatttttttttgtatttttagtagagacggggtttcactgtgttagccagggtggtctcgat

SEQ ID NO: 137133 - DNA, 4591 bp, Homo sapiens
ttgttttcctgtttgtagtcagtgcgtggtagcagcactgacttcatggactttttgtgagggttaaacacgtggaattgcagctggcatataaggactggatgggtgtttgttaattaaaaagtccaggccggaaagaggtgctctggaagctgagagttgtccctggagtatcccaggttgccagggcactgcagctaaatcctgatggaggagtaggagctcaccctggtggggaaggatggacattcaggcagagagcaaaatcccaaagatcatggcggagcaggcgtcgtcttgagaattggaagcaggtgggtgtggtaggagtgagctcagactttggctggagacagagttttactccagtgtctcacagggcatggcagacagacagcagcgggtgtttgtcaaataaatgagtcagctcttctccaaactccctcctcccagctacctcttcacctttcctggtatagtccaggggttcattttcgacccccacagagtctgatacacagtaggtgctatgtgtttgtgaaagaggctgacccagcaaagcctggatgtgtttgccttgaggactgcctgagtcctccacaccagccctccattttttccccttcaccccaatgctgggcctgagcctccatctctccacaggtggtggtgctcaccaacacccccctggaggaccagctgcgagtgggtgagttctgtcacaaccgtggcatcaagctggtggtggcagacacgcggggcctgtttgggtgagtggcagcccacctccctccctgtccccttttcccccaactcctaccaagcccaggccaagactctaggctctccctgccctcatcccttctcagctacccaggttttgggttctgtgttttcatctctccccatgtggcacaagtaccatcttacatcccagcagtgataggctgagtttgctcagcaagttttcactacatcttgagggacccgtgggacctgtatgtgcatgggacacaggcaccagccctattgcttccctctacaggcagctcttctgtgactttggagaggaaatgatcctcacagattccaatggggagcagccactcagtgctatggtttctatggttaccaaggtaaggagaccagccctagggttcctggcaggcaggtgggctgcagtagtccttcctgtctgctcttggtaccctgggcctgtttctgagactcactcttcctttaaccaggacaaccccggtgtggttacctgcctggatgaggcccgacacgggtttgagagcggggactttgtctccttttcagaagtacagggcatggttgaactcaacggaaatcagcccatggagatcaaagtcctgggtgagctgcgaccatgggggaagcagaggggaactagaagatatgttcctgggttctggccggggagttgaagggagaagacatggcccttggttcagagttgggaagacacatcctggtgtttgagatgaactacagacaatcctgtggggtccaataagagctggtgggcatgggggagaggtactgtgtttgagctattcctgggagaatgtgtccctggtatctgagctgagtggggaaaaagtctctggtgtttgaacagggcagatcagcggatctacttgtgtgtgagctgatttggatgggaagcagagaaggtcttcccgtgtagacttggagccagggacacagggtctcacggggtctgagctgagtctggggcacaggagagatggtttctgatgtccaagtggagcctggagctgagggaagacagcttctgatgtctgagctgagtcggggcaggaggttccttatcttgcaggggttgtggattttagggagaatgggtagactgacagctctcttcctgccctctgtaggtccttatacctttagcatctgtgacacctccaacttctccgactacatccgtggaggcatcgtcagtcaggtcaaagtacctaagaagattagctttgtgagtgtgtcgatgggatcagtgggctgtggggggtggttctaggcattccctagttctccattcctctcttctggttctgatgacctctccccccgccacagaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggtgggtgagtgggcgagccagccagcgcagacatgcctggcactgcaggctcaccatgcctctctgcgtgtccacactccctgccctcactgtggcctgacatatcctctcttggttctttctggcccaccaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggtcagcacgggtggggagaggcaggattggggtgggccaggttcctccatgactctgtcacttgctctctgtctgtgtcaggcccctgttaaccactgaccaccccctctctcccttcccctctccaggcctgctccgggaagttcatgcccatcatgcagtggctatactttgatgcccttgagtgtctccctgaggacaaagaggtcctcacagaggacaagtgcctccaggtatgtgggtgggacctgtggggagggcatcattggggacatttctggggaggcctctctaaccctcctccctttgcattccttagcgccagaaccgttatgacgggcaagtggctgtgtttggctcagacctgcaagagaagctgggcaagcagaagtatttcctggtaagtggtccccttggatgtctgctcccctcatcttggcctctggccatcacccctggggcttccttcggcatctcaatgcaaccggtggcgcattctctttgccattctccttatcttgaagggaagcccagtgcatccctcgtttccccttctggtgcctccttcctcacatgactgcgtgtcatttcttagagtcctgcaacctgaagatgtggtgttagcccctctccccgtctctcaggggagtgaggggtgatgggtagcttcacactaacctgcatcaccctgaccagcctctgcctgtcttcttggttgcttcttaggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacggtgagtagggtaggaggttggggctttgtcgtctcactttcctcctttttctttttttttttttttttgagacggagtttcgctcttgttgcccaggctgtagtgcagtggcgtgatctctggcccaccacaacctctgcctcctgggttcaagcgattctcctgcctcagcctcctgagtagctgggactacaggcatgcgccaccacgcccggctgattttgcattttaagtagagacagggtttctccatgttggtcaggctggtctcgaattcccgacctcaggtgatctgcctgcttcagcctcccaaagtgttggtattacaggcgtgagccaccacacctcacccctcctttttcttgttcccattctttctgtcagagatctttctgcctctgccagaagcccttctttttggcctttctttccctcagcttctgttttttttttttttttttttttttttttgccttaacctctttttagtgctggttgggacagtgtgtctggggtcctcaaaactactctcaagctcaattcacctagagtacttacaggactcagcatatagtcgtgcttgtggctacaatttattacagcaaaaggatacagaccaaaatcagcaaagggaaaaggctggtgcaagtttctaggagtcttctcccagcgggagttaaacaaggcggcctttatttccccagtagcaacagtaactacagaaataacagcaacaaggtgtaacaagacatgaaatgttgccaaccagggaagcttgttagactcagcaccacctcttttacttggggctggtcatgtaggcgcccccttcctggcacataacaaaatttccagactcccagaaggaaaggtgttcagcgtaaactgtattgtttgcatgaacggtttaggcacagtgaaccactgataccaggtagggagcggtgggaaccttcctgaattccaagttcccagacaccagccaaggagccgaccttggaagcaggcctttccaagggttgtagtttcagtctcctaggcttacacttctctgcacatatggaaactgggttggttatgcagggttctctgagaagctttctgtaaggagcagtgtcgtttttg

SEQ ID NO: 137134 - DNA, 1184 bp, Homo sapiens
gcggtggctcacgcctgtaatcccagctctttgtggggccgaggtctttgagctcaggagttcaagaccagcctgggcagcatgacaaaaccctgtctctaccaaaaatacaaaaattagccacgcatggtggcacacacctgtggtcccagctactcgggaggctgaggtgggaggatcgctggagcctgggaagttgaggctgcagtgagccgtgatcatgccactgcattccagcctgtgtgatggagagagaccctgtctcaaaaaaaataaagatgtttgttgggtgaatgcacaaataagtgagctttgttcccccatccccaccctggaactgcactttcttaaccctttagaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgtgagtttggaggcgggtgaggtggtcacgggcaaagttgtgtgtgtttcggtgtgtatataccaagaggggtgtccgtctttctgtcctctcctgatgtttctttcctagctctcgctttgtgctccccacaggcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcaggtgataagctgtgggagaagggaaagaggccaggcatctggccaggctgctgcctctccgcccccaggcccttgccttgccttcagatgttgcatgcctaagtgtaagatgtgccttttctccaaacctccctccctcacttcccaccaggcagcctaggtttctagaatgactcattcttttttcacttttattttgatttttttttcaacacatagacaaatattaagaatattatgatgaatactcaaataccattcctcacctaaatttaacaattcttaatgttttgccacattttcttcttagatttatgtagatttttctt

SEQ ID NO: 137135 - DNA, 1056 bp, Homo sapiens
agttatttatttgtctctaatggtccatattcaggttttccccagctgttactcaaaatgagtttaacagctggtttgtcaggatgattctgtgtgtatggtgcatttatctacagaacagtgcatatattatctagctcggggtgtccaatcatttggcttccctgggccacattggaagaagaattgtctcgggccacacataaaatatactaatactaacgatagctgatgagctgaaaaaataaaagaaaaaaagatccgtgcataaatctcataatgtcttaagaaaatttacaaatttgtgttgggcagcattcaaagtcatcctgggctgcatatgggccacaggttagacaagcttgatctagctgaagttttacaaagtgaacacacaggtgaccaccacctgggccaagaaacagaacctagggattaccattgtgctgtcagaataattcttagtgcagtgtttgaggccaaaccatttagaatagtaggagtatgagggtgggaacaaaatagggaagggaaaaaaaaaacagttccatctgtcactttctcccttctgacactgcagttccagagtgggtatgtttgtatttgtgcaccaaccacagtcttgctaggtcatgtgtaaccttgaacttaacctctctgtgccgcagattcctgttctgtaaaatgggaatgacagcatctacctcacaggactattgtgaaccacttggcatttactgtgtgcctggcactgttttaaccaagctttaaatatatatgtatttgctcatttcttcctagcaaccccatgaaggtaggtatcactgttgtaacacctgttttagagacaaggcacagaggtaaagatgttatcctgtgtgcctgaagtcacaaaactaggtaatacgtggcatagctggaatctgaacctgaatttctaacatctgtacactccaaaccacctcgctaatgactgcgaactgtcctaggaattctcagaggccagaagttctgtcttgtttgctattttattttttgagacaggtctcattctgc

SEQ ID NO: 137136 - DNA, 5058 bp, Homo sapiens
gtggagttttgctcatgttgcccaggttggagtgcagtggcgcagtctcggctcactgcagcctccgcctcccaggttcaagcgattctcctgcctcagccttccaaagtgctgggaatacaggcgtgagccacctcgcctggcactcagatcttaatacatttttaggctgggcatggcggctgacacctataatctcagcactcaggaggccaaggagtgaggtttgtttgagcccaggagttcaagaccagcctaggcaacatagcaagaccctgtctctacaacaaatcttaaaaattagccgggtgtggtggcatgtgcctgctgtcccagctattcgggaggctgaggtgggaggatcgtttcaacctgggaggtcaaggctgctgtgagccgtgattgcatcgctgcactccagctcgggtgacagtgtgagactttgtctcaaacaacaaaacaaaacagttttccacatacacagcactattgtaaccactgcccaaatcaacttcattgatttttctttttttgagacagtcttcctctgtcacccaggctggagtgcaatggcatgatctcggctcactgcaacctccgcctcccgggttcaagagatttcctgcctcagcctcctgagtagctgggattacaggcatctgccaccacgcccagctactttttgtatttttagtagagatggggtttcaccatgttggtcaggctggtctcgaacccttgacctcaggtgatccatctgccttagcctcccaaagtgctgggattacaggtgtgagctactgtgcctggcctggtttttcaattgaggtgggggaatggggaaggctagagggcttccccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacgtgagtaactcgagtgccctctcgccctgtccctgtccaccagccaaggcatcccggctgctttcctcatgacagtaacacttggcaccaggcacacttttcacatgaatgagtggctgttggggcctcatgttgtttggggtcgggactagttttccatggagaaagtaagattgctctggagcccactcttgaggctgacatgtaatcctatcctctgtcctcttcgattcctgatagagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccaggtaatgcccagttgttgggtccatttggcagaatgtgtttccctgaaatgggagcctgcagtgtgggtcctcccactgtggagtccagctgtggcaggtgccctgaggcatggggatctgagaagagtgattgatcctgacctgctttttcctcaccctagttcctttgagcaaagaggcttggttgctattgcccttgactgtggtgtgggctgcgtcatacctgattcccagtcagggctgtagggattatgggggagaaattctggagttaagagcacaggaatcaatatgggttcaaatccaaactctacttgaacttaggcaaatcacgtaacttctctctgtacctcagtttcctcgtctgtgaagtagaaataatagtgatctatctcatggggggtttggggaggattaactggtatttattaaaatgaagttagtacaatgcctggtaatccatgagagtttgttaaatgatgggctgtttagcacaaaatggctacccagtgattggtaattgttctctcagccagatctctggttcaacctgtgggaccctacagttgaggtattttgtgattggctccagtccgcatcgagtgcccaacccaagatagtgaattgggggcacatctggggcctaggtgaagcgtgaagattgtcagagaggccttcactctcaggtcctgttctcaaaaatctctccatcccttagctcacaagctcaggagcgccgttctggtctgggcccaaacgctgtccacacccgctcacctttgatgtcaacaatgtaagtctcctttctagggtcttctggggtcaggtggagggtgaataggtgggaaggaggtggcggctccccactcgagggctgatgtgctcacccttccctgccctgccttctcctagcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttggtgagggtgtttggccagttggccaggagtcaccccacatgtccccggcctagtccagcctccccaccagtcctctacccctggttctgctctgctctgtgaccccaggcctgaggtttacccacaccttcctttgagcctccctttgacatgaagagggtaggttggggcaaattatctccctccctcctcctccttcccactatctggccctcaggagaacttgctgttttactcttgctctgtgtatttcccttagttttgttctttcttctgtttcttcttgatctgttcatctaggaggtatgatctctaccagcagtctctctcccttgatactttcctgccttgtctccttccagatccgcccccatctgtacatctacctgcatgtttctctgtgcatcttcaccctccatagtttggggctgcggtttactgacacccccaccccaccccatctgcatattttttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttcatgttcctttatgtatgtcttccaatctttccttccatagctctcatcaccttcatatatttcttccatctttctcctcccacctgcctcgccctctgtatatacccccactctcccccttttatatcttctccatctccccccatatctttcctctatgtccacatctgtgtattccccccaacttcccctccatatatcttttttactccccttttcctccctgtatcctctgtgttccccccatcttgctctacatcattcttcccaagatctttacgtctcccatcttgatctctccatctccactttctcctaacattttcatttccgttccttagtgtctctagagagatcattcttgatagcctcagctctttctctgtgtttttcaggtttgtattctgctctgctctacctctcctccttgccccttttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggtatggggtggggctcaggacagggaaggaggatgggcaaagcatagacaggctggagaaaacaggagtatctggagccagccccgggcctttgtggggatcagattgtgggcctgccatatggctctgaatgagtaggtgttcccagccatccctttgtgatctgggagagtccagcaggcaattgcagtggaggatacacatcttctttatctgatcctctccccactgccttcacaccctccccactcataacaggatgatgacagcaactttcatatggatttcatcgtggctgcatccaacctccgggcagaaaactatgacattccttctgcagaccggcacaaggtgaggggaatctaaatctgatgttccaccctcctccaggtttgagttacccacacttagcccctctgtagaccctgaggctcttgtacttaactaccaccttcttttgtcccttctgtctctcagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtgggggcctgcatccgaagcagggtttgggtggggtgtatctgtgtagatctggttctgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctattaaatgattttggaatcaaaaaaggataaaaagaggccgggcgtggtggcttacgcctgtaatcccagcactttgggaggccgaggcacgtggttcacctgaagtcaggagtttgagaccagcctggccaacatgatgaaaccctgtctc

SEQ ID NO: 137137 - DNA, 1531 bp, Homo sapiens
taccaagataggggtgtgcctggcaagttggaggaattcaaagtccccagagtgagtgtgagattgaggagggtaggagatgagaagaaaacagaatttcattgcttagggtgagataggaaccacaagaggatttcgaacaaaagagggttgtgatctgactaaacacgtctgcatgggggtaggggggatggagacagatgggggctggaccctctgggatggtctccatcttacactcccctctttgtcttgcagtactataaccaagagtggacattgtgggatcgctttgaggtacaagggctgcagcctaatggtgaggagatgaccctcaaacagttcctcgactattttaaggtaaggcccctcccttactctgtcaccccacctcagggggcgaggtgtacacggtgacttgctggcctgtccacctccatgaccctgctgttccccctccctctccagacagagcacaaattagagatcaccatgctgtcccagggcgtgtccatgctctattccttcttcatgccagctgccaagctcaaggaacggttggatcagccgtgagttggacactggccaggctaggggaggccctgtatgggttggggagcctcatcatccagctgtcccactccagttcactgcccctacctacctgcccatcctctcttgctttctgccctcctgaccctatactcccatccccctatccccaggatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagctgtctggttcagatgataactcagagggctcaaccccaccacacctgccagttttctggacaaagaaaatgtaattgccacctcttcctgccctctctgcctaggaagagatggaggcaccagtgaggccatagtgagcaggtacttgggtccatgtgactgttaatttgagctgggttcaattctcaccttctccatgtcctaactccttgctctgtgaagaggaaagttacggtgaccaggctgctagggcatggccagcgtgccttatgtccttagggcagatcccctcccacctggctcaaagcactcagaccctgggcagccttttgtggtcatggttcccagcaccaggaatgcctgtgctgctcttagttcaatttccttgctgcaggggtgtcttaaacagctctgccgaatgcca

SEQ ID NO: 137138 - DNA, 1039 bp, Homo sapiens
gatttttatggaaatacttgagaacatctgtagaggaaaagcccgttgcttgccttacgcttcccccggccctgccgccgccccagccccaggtctgcctgtattccccttgaggatcttcagcctcctactttggagaagacagctggctgtggggactgaggggtgttcatcgcttagagcaggtagcaggaggcctaacaccagccccaccgggactgcagagttaccgtgctctgtccttggtcttggctgagtgctccagacaattgaaagcaccagtctggccactgctacatctttgccttcttctattgtactggctcctggtgcctgaggagtccattcatacttctgttcctcaactaaccaataatttatctaccttacttagaaacaagatccctcactcttctactcaaacctgagtgtaaggaatagctcaacctgttctgaactggcttgattcccatcacagcctgtgcccacatctgctgcctcctgggccagtagttcctggtcctgggcacagtatatgcccttgtccacctccttctgatcattttattttcttggcctgctctgcttgggtgaccttatccttccacagtttcttcttccccactaggacgttgaggacagaggcattttccctttggtatctagtggtgatactgtcaaagggaaagtttttcccaccacaggaactttcccattattgctctagagtaccctagacactccacaccgcagtccactggccacaccactacagcagctgaggcttgaacacaactgttgtcttctttctccagtatgccagctcctttgcggatactctatagacaccttgttcactgcacctcccccattacggctccatgtcttccccaccacaactcctggatctccttgacaccttattcgtgcctgacacccttctccatcaaaacaagcttttgagtcatgcatgaatcctggttgcatcttagttgttccccctccacctcattccattttacttctgcggtttgtctac

SEQ ID NO: 137139 - DNA, 2519 bp, Homo sapiens
atggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccggtgagcgcgtccccgaggcgtggaggctgcccctcctccttcagaacccacctcgggcggtgcccaggggtctgggctgcggggctggcaggtgcccccacccccggcgaatttcccagaatgcaccggggcggggggtcatttggggcctccctgaccttggccccgccctgggcctgtcctgggagctggggttgggtagtgctgtgggtgctaatggggacctgggggagtcaaaggaccaaagggtgtggaaatgggtgacaatggggtgaaagacttgggggggttgctgatgggggtcggagcatgtggcagtaagcctcacgccaataagtcgtgtaaggttcaaggccccgtgtgtgcttgtggaaggagggcggggtgcggagcgggtgagggacccgagggtgtataacggggggtagggtgtcgaggaagttctaagacatgctcatagggattatgtccgcagagaggcccggtgtgtgttcatgggggacagggtggcacaggtaccagaacgtgtgttggtggggtcagggctctgaggcctggtgcgtggcgatgaggccctggatggtgttaatactgcgtgtctgtccgtggggcctgcagtgtgtgagaatgcagtgtgtgcttgtggagggcaggtagctgaaggactcgagtgtggtgtgtgcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactgtcagaggcttagtggacgaagggtaaaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtgttgagtatccttgagtatgagagtagtctgaggatgggtgtatgtctttggggatcaggaagggtcaggcaggacatgtgccttttttggggtaaggttttatgtccagtttcttgctccctccttttttgaaatctaaaaagctcattcaactgaaatgatatttaaaagtttccttgcgtataaatgttcaattatctctgttcacaggggcatgt

SEQ ID NO: 137140 - DNA, 1161 bp, Homo sapiens
ggggaagcacctgatttcaaggtagcagatgacccatttctctcctcaaatccagccccagtctcatcctcgacctcctatctagctctacttcccttgggcccagggccatcttaggccctgctgtgagtccagatggttcctgggtcaggtctttccccctccttgctggcccagagcccaagaggaagcagaagacggctggcctaagccttttggtggccccattcccttcagcaatccatctaggtcatcttcctgtcgatgccagcatccctgggctaccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcggtgaggagatagacagtaaagactaaagaaaccaataagtaggtggtgtcatttctgaggaggtaatgagtgctggggggataactggcaaggtgagggagttcgggatggttgagattttaaatagggttattcacagaggcctcatgaaaaaggtgacctttgagcaatggcccaaagggagaggggagtgagccatttcgaaatttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaaccgttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacga

SEQ ID NO: 137141 - DNA, 2780 bp, Homo sapiens
catgtgctctcttctcccccttccctcccatcttctctcaacaccgtctgtctatctgtccatctgcgctcctcttcttgcctttctgcccaggccccgtggtgggggacagaaggtgccttgcctgtcacagctgccccaaggctccctctgcccttctgccctctatgatggcctcctcagtcctctggtacctgcctgccctgggcctgccttcccaggacccttggcttcccctgccaccacctagctgccggctctgagctcagcttgcccttggaaggaagggttccactaggtgacttttgcttccccaccccccagttcaacctgccctagatgtacctgagcttccctgggctcaggtacatcaccctctccccgagggactccaggtttcctgtgggggccacgtgcacacatgtgtgatgatggaatatgtttcgtgggggatggggtgtcctgtggttcctgaccccacctggcctgccctacccctctccctgccaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgccttacctgctaggacatcaacaagcgcctatcactaccagctgacatccggctgcctgagggctacctggagaagctgaccctcaatagccccatctttgacaagcccctcagccgccgcctccgtcgtgtcagcctagtaagcaccttctgttcccgtcctctcctttttcttctctcccagacccttctcctgagccagctttaacctgcctcatttgtcccacagtctgagattggctttgggaaactggagacctacattaagctggacaaactgggcgaggtgagaggcaaataggaggcccatggtggggatgaaggtcagtgggaactcctggaatctcatagcacctctcctgtcacacttcctcacattccagggtacctatgccaccgtctacaaaggcaaaagcaagctcacagacaaccttgtggcactcaaggagatcagactggaacatgaagagggggcaccctgcaccgccatccgggaaggtacacacccccatcccatctgccccaggcttccccaacccacccctggcgcacacactccataatgagaacaaagactggttctaagaccccccaaaacactctggctttcatgggaatgcctgtcacccacatatccaggtaataatcagggtaaccaggaatctgttcccatttggataaaaggtagatgaattgcaaaccagggtttggttctgagaacacccctgaaagtgctcaccagtttatttactgtaacaatttctagtcagaatatcacatggaatgaatttgaattgcactgaaatttagtgtgcaaattcgatttcacgcgatgctgcaggcctatgtactgagggttggagccaggccccttcccagaaaccaaaaacaggttgtgaaaatctagtgtcacatgagcctggggctgcaatcccaggttcttgctccatactctcctctgagtcttattttccacatctgcaacatggagacacaactttcttctggcatgaggcgggttagagctggtggctccgaggcattaccctgaactgtctagagaaagaaagaaaacctgggcttgtccctttctagtccttgtcctcacctctgtcctgagggtaggaccctgactcttcccctgtcccactcccatgcttcctgcagtgtccctgctcaaggacctcaaacacgccaacatcgttacgctacatgacattatccacacggagaagtccctcacccttgtctttgagtacctggtaaggttgagtggcagtaggtcccagggggaggtgaggagaaggccaggagccataggaagtaaccctcattcctgtaccacctcttctttcctcaggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggc

SEQ ID NO: 137142 - DNA, 1205 bp, Homo sapiens
taaggacaggtggaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctccacggtggaggaacagctacacttcatcttccgtatcttaggtgaggaggcatgggccctaggcgctgtggagacacacggggaggacctgtgaaatgtttgggataactcctcttccctactaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcaggtgagaccaccttgggtcagccttgggggtatgggattccaagtgtggggaaacagggaccccccccctcaaaccaggggcagggtctgaggtgggcagagagacctacttgttgaagatatcaatactatccccctccccgcacccccactcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgac

SEQ ID NO: 137143 - DNA, 1483 bp, Homo sapiens
ccagccttcggtcttcgtcgatgcctgactcaggtaggtatagccccttgtcttcctccctgccccacccacctacctgcttacccaccaacagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaagcctgcttgcaaatccctgtaggggtggagggtggccgagctggggtgattattgggaccttggagaattcatacctcatcaccactgtctaggaaa

SEQ ID NO: 137144 - DNA, 2972 bp, Homo sapiens
tcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggtgaggctgggctgcggtggagcctcggcagagggaacggtgggggcattgacaaccgctggggattcggcggccgagggccgcgggaaagctgctgcggggtgcgggggcgggggagtggccggcgggacagcgggctaaaggggcggggaagtgcctttgaatgaatcgcaacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggtgggttctgctacataaggcgggggcgcggcctgcgctgcgtaatgcaacttttgggggcgaggagcggtttccgattgctccggggcggctgggaacgaggcgagctttgtgacgtcagcagaagagcgggatggagccgaacggtccgagggagggagcggggacctccgtgggggaggggggaggagcctggagcctgggaacgaggttaggttggtgacgtgagctgaggggcgtgctctgaggccgagggacgacagtggaggggaggtggtgcctatgaggcagaaaatggcgcctgcgaataagcaaagtttatgacgcgccgtggtttttgattctggcggaagccttcccgagtcgagagaacgtgcaggtgattagcaccggaggggccttccatgtttaattggttttctgtgttggtactgttttgtttttagaatcaagaaaaagtcgtttttttaaaaaatagaattttgataaatcggcttgttttactgatttcttgctaaacagtccttcttgaaatttactgcttctgagttcattttatttctcgccgagttgcatctcgttttttaattgtgaaatacgtaagacttaaaaagattatataaaacatttacgcagcccagattgacggacatcctgttaaaataaacggcctacactcttcaaaaatgtcaggatcatgaaagacaaaggctgaagaactgttccaaattgaaggaattaatgcaatttaacgagtcatgataactaaatgcaacatgtgatcctcgattggatcctggaacagaaaaaaaaattattttaaaaatcaattttttatcataagattatttttgtctcttttactgtaaaaggcaatggaaacgtcggtgaaattttattaaagtgggtagatactagtactactaataattgtgatcattgtggctgtgaaaaataatatccttgtttataggaaatactgaaaaatttagggataagaacgcatcgtgtaagcagtttattctcaaatgcctgaaaaattagcatatataaatttatatatggcgaggggaaataaaattggggagatgttggtcaaaggatacaacatttcagttagacaagaaaaataagttcagatctattgtacaactatagttaataaattcattgtatacttgaaaattactgagagaagattttacatgttctaccaccccccaaaaaataagtatgtgacgtaatggatgtgttaattgccttgacttagtcattccacaatgtatacataagtcaaaacttcatgctgtacactctaaatatatgcaatttttgtccattttaaaataaataaaaataccaaaaaatgcatgtaaagaaacaacgattgagcaaatgagtaaaatattagatttggagaatctggatgaaggacatatggggattctctgtattatttttgccatttttctcaatctatttcaaagtttaaaaattaaataataaataaaaacgtgtgaattcaccatccatgttaagattcagaacactgtcttaagaaatccttctgtgcccctcccagatggaaattcccctccttgctccatgggaaactgttatcctgaattttgagttaacagtctcttccttttctttaatgttttaccacagctgtatgcatccctaagcggtatgtattgtctaagctttcactttatacatatatggaatacatatatataaaattctactggatgcatactgtgagcccttatcttcgcatcgggtaatacatggtatccacatggcatcattggtgatgttaaccttgatcacttggttatggtagtgttggccagctttctcaactgtaaaggtaccattttcctctttacatatgcagtaattatttttaaaacatgtatcatgtccagccattcctcaaaatactcttaacagcttcccatctcttgcagcgtagatgctaaaatccttacaatgaattgcaagcctttatgaagctggtctcctgcttgcattctgatgtcttcccatatctctcctctgattacgcactccctccctgtctccatccaggccggccatattggactcttgctgttcctcaaacacatctaaccttagggctttttcgagtgaggtttactcactacagagttctttaataaccacaccagtgaaatgtgtatctctgttactggggagatgagttgagattttccaaatcgggaatacaaacccaagccgtgtttttctgccattacgtcacacttttccagcaagaaaaagcctcatttcatcctgagaataaacaaaataaccacagtgttttgtaactcatttgaagatgttcaaaagggccttgaggctttgatccttgcctcttcctacctttgtagccttgtgattgtgtcactggtag

SEQ ID NO: 137145 - DNA, 1059 bp, Homo sapiens
acatatttcatatcatttcaacaaatttgaggaagcacgaataaacctaagtgactttagcaagatcagttgtacctgtatatactggcagcaagaaactagaaaattaaaatttatgataccatttatgatagcatccaaaaaattgaatacccagctgtaaatataataatttgggtgttattgatacagaccatgacacctttgttgtgactgccacctggcctgacagagattgtgagacatcctgatttcagagatgttaacaatgatttttttaaagtgtctttgacttgaagcaatatggtaataattttctgtgaaaaattatgtaaaatgtcagtcctctatgaaatctatagaagttcagcctgtgaccaggtctggaagttttgcttaccactctacagcgtgattttaatgttattttttgttcaaaatctgctcttaaaaagaagttgagcagtgcctacctttgcattggaaggtactgttaactatagctttactgaacaaattaacttcatagactggctatggaggcaagtaaagccacaaagggtggatggtggtgtgtggggtgcagggttgggtctgagcattgagccaccggcacagaagggtttgtttccctggtgtgagtgatatggggcagggtctgtgggggtcagtgcagcaaaaaaacaaaaccaacaaaaaacccacagaaatgtttgcctatctaggtgacttgtgactattccaagatttgtctgtccctccatcctcccacctctctgatcctttcatgaacaagggaaagttgacattttaaagaatcacattgatgaggttaaattgggagaatcgcttgaacccggcaggcaaaggtcgcagtgagctgagattgtgccactgcactccagcctgggcgacagagcaagactctgtctcaaaaaatgataataataataatgaggttaaattgcttgaaaaccagccaatataatgttatgtgcatttcatcaaatttggttattttttaaaaagcatttatttgaggctgctcagtatttggga

SEQ ID NO: 137146 - DNA, 2736 bp, Homo sapiens
attggtgagtctaagggtcacgcaatgggttggtgttcctagctactagtcccaactcagtgacttgaggttgcatagggttaagctgaagctgactgagaaggcactggtcagactttggaagacccagaaggcattggctaagttgggtggaggcactgaggggatctactagagccctgagggtatgtgagctacattctagtggcttacgtggtgtggcagaggatatttgctggagatctccagtctggagtgtgggccagtcatttggagactgattgaggacacaggtattggccaagcatgtgaggtccgtagggatgagtcaggtatgcccagatggattgatcattttgggtctcacaaagatcttgaatgtactccatcaccccgcacaggcctagtattgcgcacagctcgggagcggtttctggtggagccccaggaagacactcggctttgggccaagaactcagaaggctctttggataggttgtatgacacacacatcacggttctcgatgcggcccttgagactgggcaggtaagggtggggagggcttttctgttcaggtggactggcagatagactcacctggcagtactcgggggaaatgaaggctaggtacccataatgtcctccattaatacctttccttctttctctttctccaacccagttgatcatcatggagacccgcaagaaagatggcacttggcccagcgcacagctgcatgtcatgtgagcccttggggtatctggtccagagcgggggcgtcccacagtaggcaaaatgatttagcccatgagcacattgcacccccatgcagcaggccctcagctgacagtttctcatctaaccccaggaacaacaacatgtcggaagaggatgaggacttcaagggtcagccaggcatctgtggcctcaccaatctgggcaacacgtgcttcatgaactcggccctgcaggttgggccattatagttgtgtctggcacagccacgtggttgggcttcaagagctgaggattggggacagagctggggtcctgaggggactacagggcaaggggtcaggatgaaagctgaggccccacaagtctgaagtggcacgcccacgttcattcctgaactatcagcctcttctctcagcttgccctcattttccctcttctcttccctgttcccacgttcttccttctcgtgaaatcctaatgccttctctcccctactctcctgctcctctctctcctcccttccccttctctcttgttttcctctctctttcctcctggcttctttttgtgtatcctcactttgaaccttctgtctcccctctgcctcattcacctggtctctggcctctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaaggtgtgactcaaccctgggcacccccgaccccctacgtctcttggctctcctaactccctctctctctgatgaccctgcccatcttcttagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggtaggctgcccccgcatttgcagtccaattaacatcaccaaggcctctgcctcggggattttctggcctccctggggtatctaacacgccaccattttctgttaagtttctctacctgacctcaactccagccttactcttaaccttagttgcaataccatatctgcccccacagtcaacccagagtaaaccccagcgcagtctcctgccctaaatgacccccagtcttgaccgtgaacatagtctctgtgtatccctagctggagctctgcctctggactttagcagtggccttccgcttcaccccatttgaatgcaccccaagccatggtttcctcttaccctgggcaagccccaccacccaccatgacactatcaacaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcaggtgtggggcagtgggggcctggggagatgatgatggacacatagagtttgattagctgccatagctcaaggcttcttgcattaactcaccacaagcccttttggtcttttgtggataccgtttttcccttagcaccggctcgtggtccccaagaaaggcaagatctcggatctatgtgtggctctgtccaaacacacgggcatctcgccagagagggtgagactgcagaaggaggctggatgggattccagggcaaggaggcagaagggcctgggaggccgtgcagactaacagtcccctctccatatcccattcctagatgatggtggctga

SEQ ID NO: 137147 - DNA, 2625 bp, Homo sapiens
atcacgccactgcactccagtctgggcgacagggcaaaactccatctcaaaaataaataaagccgggcgcggtggctcacgcctgtaatcccagcactttgggaggctgaagcaggcagatcacgaggtcaggagatggagaccatcctggctaacacggtgaaaccccgtctctactaaaaatacaaaaaattagccgggcgtggtggcaggtgcctgtagtcccagctactcgggaggctgaggcaggagaatggcatgaacccgggaggcggagcttgcagtgagccgagatcgtgccactgcactgcagcctgggcaacagagcgagactccgtctcaaaaataaataaataaataaataaaaataaaaatgccttcaggctgtgaggatgagtgggtggggcagccagggcagagtcagggagtctctgggggccctgatcaggtgtgcctgctgtccaccccccacagctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcgtaagtgtcctcttccccgggggtggggggcggaggggtctgaactccgacttgggtgtttagctgcttatttgacacctcccctgtaacaaacaaaagacagtccaaacttaacatggccatagaagaacttgtagggttttttctttctctagacctctggctttgctactgcctgtcttgggtgctagggatacagaggtgaacaagatgcacaaaacagacaacttcatcttgtcttcagttgtctctcctggagactgttgtccctcctgggagagtcttggtttttttgtctttttgctgacaaattttcattttgcctaaaatctagagtctttactgtggcacacaaagcattgtgttatcagaattctcccccctcattttgcattcaaaagtcattccccagaggctttccctgatgggaagttacagccggtatgtgtcttgtctagcagtggcttattagagtaaaagtccacgctccatacctttttttttttttttttttgagatggagtcttgctctgttgcccaggctggagtgtagtgacatgatcttggctcactgcaacctccatctcccggattcaagcgattctcctgcctcagcctcccaaatagctgcaattacagccgcgcgccaccacgcccagctaatcacactccacacctctgactgggacacaagttccttcattctcaggccactgctgacagccttggcctcttcatgcatttacgcgtcaccccttcagccctctcacacctcagattcagaacggtttacatgtggatctaccaatggcttcccattatcttaagtaaaatcccgggctctatccccactgtccttgtacccgtcttgggagtctcctctgctctgttgcagacgctacgtgaccaaacccaactcagatgatgaggacgatggggatgagaaaggtgagggggctaacagtcagtgggcgggggctctgggttaggtctgacccacgtagggttcgtctaggtgtgcattgcagcttagcacttgaggctcacaccttcccatctctgacatcctcctgtcctagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatggtatttcctttggctatcagcgagggctggggaggctggaggggagatttcctggcagcaggatccatgaccacctctccctcacccccagcccagccgtacattgctatcgactgggagccagagatgaagaagcgttactatgacgaggtagaggctgaggtaaatgagatcccagggatggggggtacttccagctcttgcccctcaactcttcgtacatcctccccacaactcctctagctgggaacagagccaagagatccaggtcaagcttggccttggggcctgaacacctactgagagctccagggcctgaggttcctagcttcaaagtcggtgctctgacccactcagtgtgtgtctcccccgctgggcccccactccccatttctccatctgtcctcacagccggccatctggttgtctgttcacccaatcctagggctacgtgaagcatgactgcgtcgggtacgtgatgaagaaggctcccgtgcggctgcaggagtgcattgagctcttcaccactgtggagaccctggagaaggaaaacccctggtgaggggccagagcggggcctgtgtgtgggggtttcattggatggaactactatatttagctt

SEQ ID NO: 137148 - DNA, 1861 bp, Homo sapiens
gaggtcaggaattcaaggccagcctggccaacatggtgaaaccctgtctctattaaaaatacacaaattagcagggcatggtggtgcatgcctgtaattccagctactcgggaggctgaggcaggagaatcgcttgaacccaggaggtggaggctgcagtgatccgagatcgcgccactgtactccagcctgggcaacagagcgattctctgtctcaaaaaaaaaaaaaagaaaaagtccgtttgctgactcgggctctgtctgtaggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttctctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgaggtgtgacttccatcctacctcctccccttcttcctttctgattccacctccccacccccacaatccacactgactcctgtcctctccccacagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctccccactcagcagtgtggttttttcctccatggacttaactaagcaccagttttgtgcctgtgttctgtgttcttatcaaaggccagatgtgtgatgggtgcagctctgagtggttagtgagcaccagctgtgggctgggtactgctgttctaagtgctttgaaagcaccctctgtgtgccaggcacgattccaagcaccaatggcatgcccagttttttccaaaatattttccaaatattgatacgtaatcctcacaacaatctcatgcaagagttgtcatctccagtttcggatggggatactgaggtacagaggtcacagaattgctcagggcttgtca

SEQ ID NO: 137149 - DNA, 1005 bp, Homo sapiens
gtgactcatgcctataatcccagcactttgggaggctgaggtgggcagatcatctgaggcctgtgtctactaaaaatacaaaaattagctgggcgtggtggtagacgcctgtaatcctagctattcgggaggctgaggcaggagaattgcttgaacccgagaggtggaggccgcaatgagctgagattgcaccactgcactccagcctggacaacaagagtgaaactccgtctcaaaaaaaaaaaaaaaaaaaaaaaagaaaagaaaagaaaaagaaattgcaaagggctttcaggtagattctcgtttgtcctctgtgataatgctctgggatgtggagcagccgcttgggaggttgggcatctcgcccaaggtcatgtagcacgtaaggggtatctttagctaggtcttctctccagagccacaccctttctactgtgttgcttctaacatgtacctaaaagcaattttatttgcttacagtaaaagaaactacttttcagtcctcctaacgaatatgattatatgtaagcttaaaaaaaaaaggaaatgtgagccagacatgatggctcatgcctgtaatcccagcactttgggaggggcaggtggatcccttgagcccaggagttggagaccagcctgggcacatagtgagacctcatctttacaaaaaaaaaaaaattaccaggtgtggtggggtgcatctatagtcccagctatttgggaggctgagccaggaggattgcttgagcccaggaggttctaagctgccataagccgagatggtgccactgcacgctatcctgggtgataaagtgagacccctgtctcaaaaaataaaaataaataatttttttttttttgaggcaggttctcgctctgtcacccaggctggagtgcagtggtgcgatctcggctcactgcaagctccgcctcccgggttcatgccattctcctgcctcagcctcccaagtagctgggactacaggcacccaccaccacgcc

SEQ ID NO: 137150 - DNA, 1710 bp, Homo sapiens
tataccttatcactcaccctagagaccctgtatcactcaccccacagacccccttattattcactccggtgtccccaacactcatcccacaggctacccatcaactttctctagtgacccatcactcacccacaaaccccaatcactcattctgcacctccctataaatgaccccagagaagcctccttactcatcctactgagcatcttcgagtacaaaatccatgtcataacatccccataattatcttaatgcttgatccatgtcataacatctccatatttatctcaatgcttaagtggccctaagtccgtctgttaaactcactcccagagccttaagtcctgaaaactgcttcgaggaaccccggcgcttctggacttgatctgcacatgcttagtgtcagctccgaagcggccgctcgcccacaattacacctggtgggtgcccttacaccgcgccggtgcgtgcgtgcgcgtgcgcgtgtgcgtcgaaggagaggcgggctttccaatttccttcagtgactctcaggcaaggaacatggctgtctccttgggagtgtctctacgggagccgccatcttggaagggcggtcatttctgccgcggagcccgcggtcccctactcgatatacccctgtgggattttccagtggccgaggcactgggccatggaatgtaccaccaggcttctcccctccgccgcagcctctaggagttagtcacctccgaggccccggcgggcgaggcgctttgcctcttccgccctcagggtgccctcggcctcaggccgtccctaccggggagcctccgcctctttaaatatcgcccagcccccacccccaggagcaggtcgcgagacgcacccgcccccgcccctgccgccgcactgctctgtgggacgcggcgacccctctcccgcggcggccgggaccccgcgcccaccgcgtctggagcccacctggcggccccactggctacatttccgacctggaccccggccggctgcgggaaacactcggcgtctcggctgtcaccgaacctgtgcagttgccgcggggggagtcgtgcgtgtcagatttaggccaggaagcggaagtcgccagcagcgagagtttaacctctgtgggcgcagagggttgcggggattcagcgcccgggaccgtggatctgtgcagggagtcataggtgtgtgtgacatcagtggtggaacattttggctcgttttcacaattcagtcattatcctttctgctttcctcctggaagcattaaggttgaagttttcttctaaagatcaaagttttgatttgttatattagttcggatttgtttgatttttgtttgtgttcggtttcaagtgctgatttgtaacttttctcccccccccacacacgccttttgacccctgaattatttaaaagtccattgttggagtggcaaacatcctccgagactcaaagggcaaggccatgggcgctttattccggctgctgctccaggaacgtgggaaagcagcggagttttattctaggggaaggaaacaaaggcggccgagtgccagctgcacgtttggtgggatttggtcatcaggggtggacatgctgcccaatggagctgtcggcagtttgacccagcttggtccgtcgcgtcctgttctaggaatcgattattcaaagaaggaatttagagggactgcagaaaatgt

SEQ ID NO: 137151 - DNA, 1065 bp, Homo sapiens
tgttggccaggctgccctccaacccctgggttcaagcaatcctgctgccttggcctcccagagtgctgggattacaggtgtgagccactgtgccccacctggaatttgttttaactggctaaatccaggacccctggagggtataagtgaggttaaatctgcagggtggtctcacctggctgcatggggtcctactgataattttgctgtgaagatgccaggaccaaggggtggactaagcagaagggggttaacatagcagtcctgtaactattgtcctttgaaagtcctgcttacaagcttggcccttggctggcaattaggaacttggatttcgggagtattcccagaattccttaactgataaggatggcttactcttcccaacctgtttgtgcaaacagtggtttctgctgatcaccggctttcattctgggagcctggaattttggtaagcactaggtagagggtgcctagtgaccagcccccagtgaaacctttgggcaccaaacctctaatgggcttccctggggagaagcattatacatgtgttcctggatttttgttgctagaaggacagctctgtgcaagcctcctgcgagggggagacagcatgaggaggcctgtgtacagcatccttcacattctgcctgtgtctttttaccttgacgattctgtcacatatccttttgctgtcataaaccttagctgtgaggacaattatatgctatgctcagtgctatgagttcttccagcaagtcactgaacatggggggtggccctgggaccccccaacagaatgggataaattaataattatgagatattccaattctatcatccctgcgtctatgagaacctgtaattttgttgtgagagaaatggaatgcaggccgggtgtggtggctcatgcctataatccctgtactttgggaggctgaggcgggtggatcacctgaggtcaggagtttgagaccagcctggccaacatgatgaaaccccgtctcaactaaaaatacaaaaaattagtcaggcatggtggcggctgcctgtaatcccagctac

SEQ ID NO: 137152 - DNA, 1070 bp, Homo sapiens
gaacacatggggtttcacatcctaatatattctggatcagaatttgctgtacaatggatgggtggggatacaagtcctggagggcactggggcagcagggctgaatgtcagggcagcctagggcatagggtggaaatgtgagccaaagaaagctggaggcaggagagaaaatgacaaatgtcacttcttggtcccttcagtgacttcctctcagccacctctctagcaactgaatgcaggggtctgacttatctcccgccttgctgccaataacaggaagtactagagacagaggcccagaccctccctcccagctccttgatcaatgccaggccctgactcatccctccatttattccggtcacattgacaagctggaagagaagggacacgtcaggtgcagagaacacaggaagagaggtcctgactggggaggagagtgaggggaatcaaatggggggagcttctatttctcacctctactcgctccatttattttactgccacttctgccccatcccccagggagcccaggtccccacggtccccgggccaggcaggcaggtgggttctggggggaaaaggcggctctcccagcacctctgttatgagatatgtctcaggcctatggtagctagagctgtaaatcactcttcctaccctagtcagttagaaggatgaagacagagttgtctccacattgggccggaagatgccaagtcttcatccagtggtgctgcctgacaaatttgtcctcctgcacccatgtggggagcacgtggtcagggctgaatgcaaattcctcaccatcctgggtccaatataaccaagtggaagtgacttttagcctaggcagtgcctggaagtgactacaaagtatatcacacactttgaaattaagtgtatattttatttttatttttatttatttatttttgaaacagagtcttactttgtcatccaggctggagtgcagtggcaccatcttggttcactgcaacctctgctttctgggctcaagcaattctcctgcctcagcctcccaagtagctgggattacaggcgcccgc

SEQ ID NO: 137153 - DNA, 1025 bp, Homo sapiens
gtatgaatatttaaaattacacagttttgctttccagagtgatgataaaagtgtaccatttgagtcactaactcttttttttctttttaagagagtctcgctctgtctagcaggatgcagtgcagtggcacgatctcagctcactaaaacctccgcctccagggttcaagcaattctcttacctctcaacctctcgagtagctggtatgactggtgtgcaccaccacccacctcagcctcacacagtgctgggattacaggcgtgagccactgtgcccggcccattttagtcattaacttttaaaaataaacttcacacagcagtacatctcagatgtttataacaaaaaggagggtggatgtgtgtgtggggggtgagctttctaatttgaccacgtcaatattgtatctgccaagcagtttccaacttgtatcaagtcaaatgagtacttagttgttttctttagttcttagaatatttcccctacattctccatggctcggttctttccagaaaattccctggatggaattttccacatagcccagcagagggccctgtattctgagccacagtcaggcatacacagaagacactgcagacaccaatcagcaaatcaggaacgagaattcctctcctcccacactccagccaaagggctctcaggttccagttgcagccggtcagctaacaactgacggtgtctgcacttccttttagtctaggcggcggtagaaatggtttctaagaatacccagtggctctggaaaacatttccatcatgtgaatgagcctgcgcgtattttatattacagcttttattcccctcagattcctattctcattttaaaatgtatttaaaagatatagagacatataaagccttcagaggaaaatgcattaaaaaggaatatatcacaatggtaaaccatgattactactaaagagattatggcttatttcactccattctttaatttcccagattttacaccattatcgtgtttcttttattttgaatatt

SEQ ID NO: 137154 - DNA, 2955 bp, Homo sapiens
atcataaaagggtgcttagggcactggcccaaaaagggtacttaaggatttctccgcccagatgccaaagccctaaggtcagccccaaatgacctgtgttctgctttatacgtctatgccactgttggggttaaagccctaggcacgcaggtcttgcctcaactgcgcctgcgcgagtcaggacgagcgcttgccccagatcttgacgtttcaggcggcccctcctaatccggaacacgactcacattccgttggtcttgccttgacagacgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggtgagggcgggcccgggagggctcggtttctggagcggctgccgggcacgggcagggagcccggaccgaaagctcagctccaggatggctgcgcttgggccccggcgttccctgcccggaaccggaggagtggtttgacccggggcgagaccatcgtcgacagcgggggtggggtgggtaacaggaataggcgggcaaggctgcgggtgatggtttcgcccgctgctagtggtggtgcgcctgcgcagagccggaagccctttggtaggcgggacccgaccgagtggtgccgggattccgtcttaacccccgctaaggtgtccaatgacctttccttaccaactgcggggagtgtgtggaaacgcggttcactccccggtttccttattctggatcagtgtctgaccgcccccgccgggagaatgtcaggattctcgcctctgtaaccgccttccatgatccctcattcagtttagaccagtaatatgcctgtgacccctcacaggttgtcaaggagaattttggagctccctctttacctccatttttctccccgcaacaccataccttccttctccttttgctatgacaatgtctggtggtccaccattacctccccagttcggctcaatgtctggtcatttccatttccacccttctccccattacagtccctagtgacgcctgttacatctcccttccgcatagtatgtagtgaccccccccccccatgaattcctcatcatagaggcttgggacttccattagccacctaacaacggtgtctgtggtcctaacatcaacattacaccccagggcttagggatgtccacagtgccctttaaggacatgtttggtgcaacctccatcttccccaaactaagggcagtatctgataatcctctctttcccatcaccgtgcctgcgactcctccctcaccacagtaactggcatttcccccgttctctgttaaaaaaccaggacactttgggaggctgaggcgggtggatcatctgaggtcaggagttcgagaccagcctggccaacatggtgaaaccccgtctctactaaaaatacaaaaaattagccgggcgtggtggcacacgcctgtagttccagctactcaggaggctgaggcgggagaatggcttcaacttgggaggtggaggttgcagtgagctgagaccatgccattgcactccagcctgggcaacaagagcgaaactctgtcagaaaaaaaaaaaaacagaaaaaaaaaaaaaaaaaacccaggacattctgttcgtgcttcttatgtacctgacggctcagtgcagtgtgtactgacttccccattggtccccagcacagagtcttgtgtgctcctctaccctccaagacagtatgctctgtcccccttccctgttctctcccccgcaaccctgtgcagtgaagctgagaccttggcactcaagagtgagacaagcaacaggagggcctgagcagagaaggaactggaaggacttcagatgtgagcaggatctcttggactgtcgtgtgaaaattaggctgcagggggcgacaggagcctggactttgaattttattttgtcccctgccactttgcttctagactatcattattggacctctgaattcttgtctgccttcttgtaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgagtcatggaagcgaaatggcaggggctgtggatggacccagttgtaactctgggatcaaaagggtgacaacggttgggggaggcctttgcagaaggatgggaacatcagctgcgcttctgttgggcattgaggacccctacatctgcacatacacacaggtgactgtccgggatggcatgagtgtctacgactctctagacaaggccctgaaggtgcggggtctaaatcaggactgctgtgtggtctaccgactcatcaaggggtgagtgtggcagccccacgcccacccactgggtgtcccacctcccatcccctcctcagtcatttgattccttctgtactttatcacagagtcttccattagtcttcccttagtctttagtccccccttatctgcagggtacatgttccaagacccccagtggatgcttgaaaccatagatagtaccgaacccaattgctatcagtcggaacatgtttctattcttgtcttctacccataaatgtaatgccttttccgtcttaactaagcacgtatcatgcactccggccatcacttttgcagtttgaggtatgacatcaaaactagcatgaatttatttttccttcttcacaattccaaagatggaagattctttcttacagtagatctcagcaacctcagcatatgattttcttttaagtcaagaacttttacctttttgcttaaaggaagcacattacagc

SEQ ID NO: 137155 - DNA, 2223 bp, Homo sapiens
gctcccctggatggcgaggagctcattgtcgaggtccttgaagatgtcccgctgaccatgcacaattttgtgagtgcagggtggacggtgggggtggaccatggttgggggtgtccttgaccaggtctcaaacttccctgctctgtggcatcaggtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagtgagcccagcctggggtgggtggggggatggggagcacagaggcccagccacgaggcccttacagacagctgacccgtgtccccttgctttatacccttcatgccctcaaggttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttataagcatctaactactttgctaattctagtataatcatactcaagcctttccattttgaaatacgtattattttatcataaattacttcccttttattgcttttttatgttaaatattatataaaactatagctatattaaaatatattattgctctaatatatattttatgatgtgcatattttatggtatatttatgttattgtatcatgttgtattacataattttatataatgtagaacatcatacatgtttatatgatacataaaataaagttagggtattattttaaattatgagtgtatgtgcattaattacctttgagtttcatttcaggatagtgaagggaacattaacatatttttgtaactttacaatatgtttagcatatatcatatgtataacatgtatgtataacaatatggtaatatgtatattttaaaacattgccatttttatatagatgatacatattatataacatttgaaaagtacatgtaattataatatataattataaaatatgatacattaccctttccccactatctgtgtggcctgctatcctgcctttaggcgtttactccattgtcatctcctcctcagagaaacctttcctgacactttctaggaacactttgtgtctccttattttgctttactatttttctttattgcacctatcaccatcaggcatattatatatttgttttttatttcagccccaccagggcaagaactgttattttgttttacagttttatctccaccacctagaatggtatctggcacacagcaggcactcaataaatgtttcttgaagcaatgaataatagtactgccagtggacattcgctctgtgtgagccaaatgcatgtttatggctgggggtggggtggggggctttctcggttctctgattcctggcagtgatttcacagcctttcccctggcagcccccgcacccagcactgtgacccggagcacttccccttccctgccccagccaatgcccccctacagcgcatccgctccacgtccactcccaacgtccatatggtcagcaccacggcccccatggactccaacctcatccaggttggtgctgtgggggacaatgccggggaccacagggcagagggtagagccatccctgttggcctccatgccctctttttgactcctgtccctcttcttctagctcactggccagagtttcagcactgatggtgagtcccctgtgcctgcaccctgacccccgctgccccacttacctccactcacatcctctctgcaactgcagctgccggtagtagaggaggtagtgatggaaccccccgggggagccccagcccagccagcgtgtcctcg

SEQ ID NO: 137156 - DNA, 1772 bp, Homo sapiens
ggacgggctcgtttggcaccgtgtttcgagggcggtggcatggcgatgtggccgtgaaggtgctcaaggtgtcccagcccacagctgagcaggcccaggctttcaagaatgagatgcaggtgctcaggtgaggtggcatgtgtgcgtggatgggggtggcaggcccggccttggcatctctctgggaaaaggccatgcttggagtgcttcctggacatcacctgtgtttgtgttgttaaaccatcatcagaagttgtttctctctgaagggtgtccctttcccctctgggaaatgagtatgtttagaggacctgtgatcatgcagttgtttgtgtttgggttattaatgaatggttctgcctccaaaatgtgggtcttctcatttgcctgctgcgaactgggtctgtgtgtgggccaccattcttgttactgcattgccaggaaggcttccatctttccttcccctctgcttgggctacaatggtaatgttctgtttatagtgttggttcttgttattcattaattctaataccttgatttaaacaatattatcatcatcaccataatctaatcattgcttaattattataattgctgtaatatgtaatcaatacagtattcatctagtcacgctaagaaagccaggtgtctcctttttgctgctatagttactatgtagcatagtactgtatacctatatactacaggtagtactggatagcgtctaccaaccctggggatgttggcattggcttttcctctgtgtcagatgggcacaattatgttacagagaataaggtagctaatgcaatgatcagttttacagttgaggaacatgaggcccagagaggttaaatgtctttcccaaggttgtaccttgagtacctggtgaggcctagatttgaacatgagtccagactccaagctctttacctctaagcttctcatgctgctgaacaggctctaatcatcatatatcaccaatgttttaatcctgcatctatccatattatattgatacatcagtgaggaaggttggcattctgctttctcatctgtgagatggtcacagacccaggtaatggtcagagtcagaggggtgggggatgttaatgattagaaatgctgctgtaggcagggagggggaggggcagcaattcctccctcctgcttttgttgggagactcggatggggaagctccacatatgagcccacagcacagaatcatagcccagtaaacacatctcacaaattcatggaatctggcaatgctttggtcctgagtgccccaaaagacagggtgaaaataaatgaccgaggaaggtaaagaacagtgccactcctgatgctcggtaagtgacagttgctatttttcctccccacctctgacactgccctccctgcctgcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggagtgagcctcccagcctggggaggggtggggggaaagggtgggggaaatgaggtaacccccagccaatccgccacctgcctccacccccacagctacctccatgccaagaacatcatccaccgagatctcaagtctaacagtatctatctgtccctgggctggggttgagtgggggtgtcaagg

SEQ ID NO: 137157 - DNA, 1042 bp, Homo sapiens
ctaatagccatgcctctcaccctgcctgggaggttcccattggtgcccctataccactcatccctctgatcctgaccaggagccccttaatatcacgcaaactatccacaaccttgacgtgggcagggaacgcctgctaatgccccccacactcagccccgctgtgactcctgaacaggaagcccctcggagggcatccgaacccactatgcctctgatgttgaccataatgccctccacaactgtcagacatcagactctaaccagagtccccaagaatagtacctgaaccagccacacctctgacttctaagagactgccattaaagccccctggctggccacagctctgccacctggcaaggagctctgggacacatgcccctcccttgtaattcccagaacccccacaagaggcatccttctaagcccttgacacccccactcaaccccagcccagggacagatagatactgttagacttgagatctcggtggatgatgttcttggcatggaggtagctgtgggggtggaggcaggtggcggattggctgggggttacctcatttcccccaccctttccccccacccctccccaggctgggaggctcactccatgccctgggcagtctgccgggccacgtcgatgagctggaccatgtcgaagcgtgtgtcggccacatgcaggtgatggtagaggctggagccctcacaccactgtgtgatgatggcaaatcccggccgggtcatgaagcccataaacagcaagatgttgacatgtcgcgtcttcctgcaggcagggagggcagtgtcagaggtggggaggaaaaatagcaactgtcacttaccgagcatcaggagtggcactgttctttaccttcctcggtcatttattttcaccctgtcttttggggcactcaggaccaaagcattgccagattccatgaatttgtgagatgtgtttactgggctatgattctgtgctgtgggctcatatgtggagcttccccatccgagtctcccaacaaaagcaggagggagg

SEQ ID NO: 137158 - DNA, 1017 bp, Homo sapiens
tggacacccacagtcacctaggccttgggtatctagcaggccccagggccgggatacctagaaccctctaggccccagacccccacagaagtacaagctcccccagacccagaactccatgttttcccgagactcagtactttccaggtccctaagcctcctagaaacccgtgggcctataatcctctgagccccagatacctacaatccttgacaaccccaaatttaaatccctctgttctgaaagcagagaatcctcccaagtcctcaaggacagagaatcctctgggccttgatactgacagtaccccagctcgctaaaaatgaaccttccaagtccctcaatacaaaattccttgggcctcccagcccctgaccccagatcacccctttcctgcccccgtctgcccccagattatctttatggtgggccgtggctatctgtccccggacctcagcaaaatctccagcaactgccccaaggccatgcggcgcctgctgtctgactgcctcaagttccagcgggaggagcggcccctcttcccccaggtgggctgggtagggggctggacaccttgggtgggtgactctgggatagaggaagactgagatggaggcagatgtgaatatgaaagctcagaggtatagtgtgtgtgtgtgtgtgtgtgtgtgtgtgtgtttcaccatgaggctgggactgttgggggtgtgtgtgtatgtgtgtttcgccatgaggctgggactgttgggtgtgtgtgtgtgtgtgtgtgtgtgtgtgtgtgtgtttcgccatgaggctggggctgttgggatgcccacagggctctggacacccctcctcacccccacctgccctcagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggag

SEQ ID NO: 137159 - DNA, 2234 bp, Homo sapiens
ctggggagggggtccctgggggaaccgaggggtcctggaagtgggaggggctcccaaggtattgaatgaggttgaggggagctggtgaagggaaatccttgtggggctaggtgttgggtggcatttgaagatgtggatcttcagagggatggaagatccatgggaaggggctcaacagtaggggtttcttgaggatttggaaaattatgatgggaaataggtgtgctggagagatttgggaccaaaaatagggttttccaggaacttcagggctccaggaagggattctgcaatgggttgcctggtatttgggcacttccaggaaggaaaacgccctctggggaaaccaggggcggaggtcttcaggaatgtggaggttctaaaacagaagtagatcctgaagtgaccacgagtggggttctaaaaggacttggggattccacatgtgagaaccggatttagggccaggaggagtcaggtttctcaaggtactcggggatcttgaggaatgagaggtggaatcttggagaaccgggagatgggttctcaagggatttggagactccaaaagtgagaaatggattcagggcccagagaagggttgcccagggattttggggttctcagagtggggtatcagtcggagaagaggctggcgaaagacttcctcaggctgcggatggtctcagctttcacctcgtcctggctaaggctgggcctgggcggggctggctctggaaggttgaaggcattggtcagagactgggatttgctagagagagacaaggtggaggcgtgggaggaagggggaagaggaaggggaggaaggggagagaaacacaacgttaccccaggcccagccccagccctgcccctctgatcctggggctgtgcctgtgacctccccacctgccaccatgggcctggaccctaacaggttctcaaggctgggagcactcaggtggagtgggtggagtcctgggccagggaggcgagatctgggacaggctgggaggacttggatccagggtgaagtgtgggattcgtggcaagagtcctgggcagaaccttctctgtgaattcttggctagtttgatacaaaggggaagatgagcagggaagtttccaatctaagggtgaggtgtctaggagggcatagaaagggcttggaccaaggacaggctgttgggcaagtcagcctaaggcagagcagctgggtggggcagggaggacgtctgagctgggatgggagttggaatggaccagaaaaggcagatgggtgatgattcgcggggagactgagatgggccagaaggatgtgaaggaggaggaaaagtatgaggatggagtgggaagagccagatgataggaggactaggactcgggccaggagttttagggatgggttggtggcgggggggcgagtttggcagggaaggctctgggctgggcaggaagttgcagagggtgggtcagccaggtgcctgggaggccctggaggaggaaactttcccagggcctttgaggaggaattcgaactgagtgcagtttctctgggattctggcaccaaattcctggggtgggggtgcggagcctctggtgggccgggaggagcgaaagcttgggggaagggcttggctcaggctggagagagttcgtgggacccctgcataggacctgggtctgaggagcaagggagctagggctgctctactggggcagcggcccgctttgtgagcagcaaggcgaaggctgctgtaggggtccccttacttgagctgggggtgcggaggtccccctgcagcggcggtggcgggtggcggcacgtcctggctgggtttctgggccagctgtggtttgggacgtccagcggggcccgggccgctgggccgaggctgctgcgtggtgggtggcccagtgcggggcacgggacccgcctggctggcctggcgtgtggggccggctgggcctgggggtttctggggcgggccctggcgctgctgcccgcccggtggggccccagaggcctttggcggagccgggccagagacggatgtctgacgggtagcctgtggggggcccgcctggcgctggggagacggagaggcgggcgggcgggctgctggaggcgccccggggcctcccgccactggccgggattggcggccttgaccctgggtcggcggcgcggcctgggacgcgggctgctggggcgctgaggtgggacttggaa

SEQ ID NO: 137160 - DNA, 1033 bp, Homo sapiens
tttgctgtcggtccagttcgcagaatactttaaaggttactaagtgcctcgccattcaccaagatgtctcgattcgcagagcactaaacaatctaataagggttttgctagtcaccagggacgtgcaagttcagtctagtgttctgccattgcaagggatggccccttcgaaagttcgtcaggcaccttacagtgtactaagcacattgctgttggctgaggacctctgtgccatggagtgcttcagtttgcactgctgctgcctggcatctgttcctccctctaccccacctacccctgggtgctcatacctcaatgatgtgatcccttccgtccttgccatgtagcgcttccactgcgcagatgtccagtcccccaaaaatctctgagcacgtgtccacccacagcttgtatctgccaagacaaagggtggggaagcctgtcagtctctcacctgagctgtcgtgctcccacccccgcttcccctcacaccctgagttcgggctgcccacctgtcagacatggcaatttgctccagcatcgcagagccagtattggtcttccagttccctgacactgacgtcctcctgggggacaaggggacagaagctcaggggtgcctcagctgcatgaggcaaggcaggggaccccttccagggctttggtctctccactcacatgtaggccttgtagttctgcccaatcttctggacacgcacgtcatatttggcatcgatgaagggctcggcagtggcatacgtcttggtcagtgccacgacacttgcgatgtcctggaagtcatgctggttgtcaaccttgacctgtggaagtgcgggcaaggatcagggcctggtcaggatagggcagctgtggggagtgggggtgcctgggggagcatgtatacatgacacacaggtgaggcgagtacacaaaaattaggtggacatgccaaggcgctcaagcaggcacgatcatgggtctcctgttttgtatgtgagcacacaggcacaaagttgggtgtgtagaacactga

SEQ ID NO: 137161 - DNA, 1118 bp, Homo sapiens
gtctcttgattggacgggtaatcttttgtgttgtgtgtgttcccctgatggtgatgtgggtttgggtgaggggagggaacctgggtgtgtgcccaagtattgattgtgtgcctaagggtgtccagtgtgtgctgccctggagtgctggctgctgacccacgctatgggcacctggctggctgaatgactgtgtgggtgtctgtgctgctccagagctcatgtgctttgagcctgtgttggctgtcagtctcaatgtcactggcatctctgggtttggcgatgtacatctgagttccaagggctcatgcctctcaatagtttatgtgtgcaggtgaggcttacatacaaggtttggctgaggggttcagtcactacatgctcaccaccactccccaccccccccacccccacacacacgcactggcacacacttgcctcactatcatccatccactgtaaaaacaaactttctttttactggaacagtcccccacgctcataccatgcctctgcccgggaaagcaggggcgggacgtctggaacttgttggtggggtggagtgagggacagacagacagggctctgggttcaattctgggcccggaggtggagacactgtgtgacccccagctgctgcctgcctgtctctgacctgtgtgtcctgggaagtgactcataatgcagttcccactggctgggatcccctcagtgccgccccacccctggaggtcaccctttctgccctgagcatgtctcctctgccttttccccaccagctcagcagtacaacgtaccccgtggttgtgaagatggggcacgcacactctgggatgggcaaggtgagtctctggctgggctgtgcataggtagatgtgtatttgtgcaatgcacaccagtcattctgtgtgatcgcgtctcctggggtgtcgttatctatcaggttggtgcaaaagtaattgcgggttttgccagttcttatggtaaaaaccacaattacttttgcaccaacctaatagatttttgttttctcacattcagctgacctcatcgacccctttttcctcctgcattcagccaattttgtgtgtcctgttattttgcttgtctccagcatcgtg

SEQ ID NO: 137162 - DNA, 1038 bp, Homo sapiens
tcccgcccctgctttcccgggcagaggcatggtatgagcgtgggggactgttccagtaaaaagaaagtttgtttttacagtggatggatgatagtgaggcaagtgtgtgccagtgcgtgtgtgtgggggtggggggggtggggagtggtggtgagcatgtagtgactgaacccctcagccaaaccttgtatgtaagcctcacctgcacacataaactattgagaggcatgagcccttggaactcagatgtacatcgccaaacccagagatgccagtgacattgagactgacagccaacacaggctcaaagcacatgagctctggagcagcacagacacccacacagtcattcagccagccaggtgcccatagcgtgggtcagcagccagcactccagggcagcacacactggacacccttaggcacacaatcaatacttgggcacacacccaggttccctcccctcacccaaacccacatcaccatcaggggaacacacacaacacaaaagattacccgtccaatcaagagacacacaactccacaggcacactccacagaaccgggcacatactcaacacacaggcacacataaaacacccctaggcaaatgcacagcaaataaggccctacacaacacacagaggtgtatgcacttctaggtattcacatcaccactgggacccgtaagagacccacgccacattcctgggcatacaaaaagtatatctagacacacacacaacatgccttgccacatatacaatacagagaggctacacacaaccagagacacccacaactcagtttgcagaaaacattcctgggcactcccaccccaacacacatacagtcacacattcaggcgagagggatacctcaagtctcccccgctcctggatggggtagaggaaaccaggttggacggccctaggctccccgctccctccacccccacccccacagcacagctgcacagtgcccctctggtggccctccctctcgctgacaaggtagagagatggcattcccggaggg

SEQ ID NO: 137163 - DNA, 1038 bp, Homo sapiens
cctccctaaattcccccagcctcttatatctcttaatatacacaacccctaaactctgccgtctccaaactcctccagcccccaatcccaaattcctcacccccaaactcctcaacctccagaattccccaatcccctcattcctcaaacttcctcagcccccttctcccccaagtgccacaaccccataaccccgcaactcactcagtccctcaataatttaaactctcccaactctctaaaccctaaattcctctgcgctccccaatccccttaaaatccctaagcttaccaacccctcaagcccaaatccagccccctaatcccccccataggctgccccggggcaagatggggtggatgacctgcccaggtcagcagatcagctgggccggggcctgcctgacatcccccttccccacagaacccaccatggccccctttgagcccctggcttctggcatcctgttgttgctgtggctgatagcccccagcagggcctgcacctgtgtcccaccccacccacagacggccttctgcaattccgacctcggtgagtcctcaccccactcagcccacacactctgccttggtttccctttcagtccagtggggctcaccatggcacttacctctagaatgattccactcgcccctgcacttcctctgctttagccacactggcatcctcacacttccttgagtactctgtgcccaagcccaccacaggatctgcatgctggctgctccctctgcctggtacactttccccccaggtatccacatgggtggctgcctcaaacgtcaccttctcaggatggccttccctggccatcctgtttaaaattttaacccctgccccttagtactcctgatctcctgttaaacagaaaaatattcagtgatacttgttataacacagtaaggaagaccatattcaggaccatggtgatgggtataggaaccactgcaatgggatcttgcagtcggtgggagagattgggctcaacactgaatatagcatgggccagtgggaat

SEQ ID NO: 137164 - DNA, 2831 bp, Homo sapiens
ggaggaggttcaggagcctgagtaaagtttggtcaagcaaagaatctttgtcagccccttacccaggtctgtaattccccattatacttaatgtctaacattccatatccttattttgtttgttcttagcctgtctcctcctggctagaatgtgaactccacaaggaaagggatttctgtgttttgttcactgttgtgtccctaacacccagaacaatgtctggcacacagtgggcactcccaaatatttgaggagtaaatgaacaaatcaatgtatgaaaatggcttaagcagtgcccggcaaagagagacactcaacatacagatgaatcaatgaacaaatgtgtaaatcactttgtgtgctgtctggcatccaataacccctatttatgtatgcgctttgctggtatgatgatgatgatgatgatgatcttatttttattggctcatgcagtccatttgactcatatttccctcctctcctgcagtcatcagggccaagttcgtggggacaccagaagtcaaccagaccaccttataccagcgttatgagatcaagatgaccaaggtatcccctgcccccgcctctttcccagcattttctaacatcttcctcctggtcaaaacagaaacttctggccactggttggtgcgagaaagttggctgtgatcttgggatgctatatgacttcagggaagaacctggagtgggaggattatgtcagtaaaagagacacttcccctcatccatcaacagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcacctgtccctccctggtccctctaattctcccttgtgactattctgtaatcccactccccgttcctgagcccccgggattgtttcttggttccccagaatgttctccaagaacccaaagtgctgttccctaatcccactgacccttcctcagcacatctgcttgttgctctgcagctctgactattccagacaccagagggtgttacactgacctcctggctagtccaagcctgttccctgatggctcctgatggcctctgagcccagtgactatcttgaagccccactggctattcctgtgcttaaactccttagccgccaaccgggtggggccccttactactgccagtttttccctgtcctttgggacaattccacaggcgacctgcctgactgacccccagggcctattccccagccaccattccaggacactgatttactggcttactgttacctttcaggacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagacactgtttctgtgtagtgcctgggaacaaacccatgttgctgatgacctggtgtgagcaccctgggaccagtggggatgagggatgccaaatgttgggtttttatattttacttaaattctgatgtactggtagtaattctcaacattggcattagcactgatgatctgcaacagcagcaatggtcactgaacctgcattatcaaccgtaacctctgaataatttctccagccaatactttaaaacattttcctatactgattcctaattgctatttgcccagggctttctagttataaattatcccacagctgacaaatcactgccttactggaaattccccattcacacatcttgccagctgacagagtcattgacaaatgccctaccaattggcaaatgactatcattgcctcaagcacagtcctgatgttgtccagtgaggatgccccatccaaacacgtgggtgttactgtcctcatcctca

SEQ ID NO: 137165 - DNA, 1079 bp, Homo sapiens
gagggagacctgagggtgaggagtccacacagggtggggacaggttggctggcctgccgttaggaatccctaaaggggaacctctcctcatggtgtcgccacagttgttgtgggtgggcgtgtagaaggatctaaccacattgctctttattttcaggtgcttctgtgagccacaggttcaggactccactaggaaactggattgtctgtgagggggaaaagagagagggacactgggactgaggaacatttatggcgtaaagagctgggatcttagtatcacatcaggagcttttgggtctcggagacctaccccattccttcaggcagagcagggtcaggagcttgtattttggtgaggagactggtgtgggggagaaatggacattaaattattggtactaatcatacacattatttccaatatcgtatattatcatgcctaatatcaaacattgtttgcaatattataaataatcactactaaagttataagttatagttatcataactacttctagtaactaatgcttgtaagtgctatatgcctagcactgttccaagtacttcacatatacaacctcatttaatatggacattgtctctatgagttaggccttctttttatccctgtcttacagatgcaggaactgaggctcaaagaggcaatatgatttattcaaggacacagagctaagacatggcaggggcaagatttgaatgcagatgatctggctccagggttcctgctttttttttttttttttttttgagacggagtctggctctgttgcccaggctggagtgcagtggcttgatctcagctcactgcaagctccgcctcccaggttcatgccattctcctgcctctcgagtagctgggactacaggcgcccaccaccatactcggctaattttttttttttttggtatttttagtagagacagggtttcaccttgttagccaggatggtctcgatctcctgacctcgtgatctgcccaccttggcctcccaaattgctgggattacaggcgtaagccaccatgcccggcctttttttttttttttttgagacag

SEQ ID NO: 137166 - DNA, 1358 bp, Homo sapiens
ttgaggaggagtctcgctctgtcgccaggctggagtgcagtggcacaatctcagctcactgcagcctccgcctcctgggttcaagcgaatctcctgactcagcctcccgagtagctgggactacaggtgcgtgccaccacgcccagctactttttgtatttttagtagaaaaggggtttcaccatgttggccagcatggtctcaatctgcccgcctcggcctcccaaagtgctgggattacaggcatgaaccaccatgcccggcttgaatcattagttttaaggaaacccaatttgtttatcattattattagtctacattctttgagagacagtagagcagaatgtgattaagagcatggactctgtagccagaatttctgtataagaatcttacctccacaacttattagttgcttaacacaggaaaagttacttaaacgccctgtacctcagtttattcatctgcaaaatgtaggtaataatagttcccgcctcatatagttggtgtgagaatgaaattacttagtaaatgtaaggtgtctagaacaatgcatctggcatatattaactgctacctcagtgttgacaaatttctccttctattcttagttggttgagtatttttgtcgtgaaaggatgttggacattgtcaaatgcttcttctgtgtttattgacatgattgtgtgaattttgtcctttattctatgaatatggtatgtagtacattaattgattttcatgcaagttgatacgttcataagtttgtttatgatgtgtctaggtgtagacatttgcattcctaggctaaatctcacttggccttggtataaatcctttttgtatgttgtaggatttagtttgtgattattttgttaaggattattgtatctatattcgtaagagacattgctctgtagttttcttatgatgtctttttctggttttggtatcaggataatactggcctcatagaataagttggacagtgttccttcttctatttttgggaagattttgtgaagattggcattaattttttttctttttttgagacagggtcttgctgtgttgctcaggctggtcttgaacccctgggctcaagcgatcctcctgctttggcctaccaaaatgctaggattacaggtgtgagccaccatgcctggtcggtattaattctttttaaatgtttagtagaattcaccagtgaagacatctggtcctgggtatgtctttgtaggaagttttacttattcctaaatcaatctcttcacttgttataggtctattgagattttccatttcttactgagtcagtttttgtagtttgtgtctttctaggaatttgtccatttcat

SEQ ID NO: 137167 - DNA, 1080 bp, Homo sapiens
ttcataaggcccaggttctttttctttttttttttttggcctttcagcatgtagaatatctcctggcacacagtaggtgtacaataaatatttattgaatatgaagtcctgagagcagcatctggcatgcagcagatgtctagcaaatgtttatttaattaataattgaaggctgggtgtggcggctcatgcctgtaatcccagcactttgagaggacaaggcaggtagattgtttgagcccagaagtttgagacaaacctgggcaacatagtgaggaccccccccatctctacaaaaaacataaaaattagctaggcatggtggtgcgcacctgtagtctcagctacttgggaggctgaggtgggaggatcacttgagcctgagaggttgcagctgcagagagccatgattgtgccagtgcactccagcctgggagacagagcaagaccctgtctgaaatatatatatatatatatatatttttttttaaagtctgacttgtggcatcctggggtccctggctctttttctgaagaaaagttgtctccccacattccatgcctaagttcttgcccacagaaggatgggtggggaggtaggaactttcccccagctctaagggagagttcttatgccttgctcataacaccaaggtacccttcttatactcaccgcacgaccttcaccccattccgaagaacttccatatccacagagaatccaccattggcatgggccacaaggttgagatcagagaattcggcctgggaaggagaaaaaaactggtgattcacctacatcacacaaaaatggccactcagtttgcagtatggacaactgacccccaggtccaaatgtcccaacttacctgttctactttaatgtcaatttctccatggatctttttccctttgaagtattttgccctggagaggaaaaacaacacatctgtcaatgatgaaatctcagaagggaagacaaaacacaggcccttgacccttttgccccttcaatgctactaaagaaaccacaaagtgccttataattattgaaatattttgaaaaaatcaagagtgctt

SEQ ID NO: 137168 - DNA, 1101 bp, Homo sapiens
taggccatgtgaccatgcagcccttcatttggggacagtctgcttcaagggtctaggggctgagaggaaggattgaggaggcctttctcctcactccctttcctcctccaacagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctggtcagcatctcagggttcacgatttgcatgcctaagtcccccttgcccttctctgctgcccagctcctgctgctgaggccttgttcctgtctctgattcctcctttcctggccctgataccttgtttccacccctggtcccccattcacacatctgatcacctctactccctcctaccgccctcattccttcctctgaacccccttgctgattccctgctttggtccaatcccctgttgccctgtctctgcagtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgcccctgtgagtgtcccacagactgtgctctgagggtggggtggcccatgcaggataaggggtttccaactctctgctgtggacctcacgtctctgcagcctccctctcactttcccaccaagacctccagttctgactctgtgacccctacccctcattgcagtgaaaggatcatggtcagagtggagtacctgggggctgtgcatgcccccctgtggacctaatcctacccgtgcccgccagcgcctctgcacacccttgctccccaagtacccgtgagtgagagggcaaagtatgcctgggagggggtcattatattacaggcgggagagtcggctaccccaggaaaccagggtttccactgctgaatcta

SEQ ID NO: 137169 - DNA, 2794 bp, Homo sapiens
gaaatggggaggggagagtagagaaggaggcagaggggacagggtggggtcaaagcaggatgccctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgctcctgctgctcaccctgccagccacaggtgagggggtgagggcccagctggccccaggggtgtccaggcccaccacatccctgaccgagccccacccacccatcccctggccctgttacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggttagggggagcctggggtgggggatgggggggagggaaggactgtctgtgggggtcacccaaaactgggcactttctttctctgggacttccaagggtggccctgaggccctgatcgtgaccatacctcagggtttctcaaccttgttactattgacatttggggctggaaattcttggctgggggaggggattgcttacctgtgtattgtgggatgttttgtaacacccctagccttccactagatgccagtagcaattctccccaccagctgtgacaaccaaacatgtcagcagacattgccaaatgtcccctgggggtcaaaatcacccctgattgagaaccactgacatagctcacacatattgagcacctcctgcacactggaagcattgcaggtggggtgcagcttggtatttccctaattttgatgacagctcatgtttattgagtgcttactgtatatggacacactgtgggggcgggaaagtttggggaattcaaagggcagctctaggcccctaattatgatgacacttcacattcattgagcactccctgtataccagctgcatggcagggttgggagatgagcttgaggatttctgagggtagctctagtctcctgatcatgatttccagcttgcatggattgagcccttaccgtatgccagacctgttttctacttgtttactatatatcccagatacaccgtgggcatggggagcttggggatttttgagggcagctctgggccccaagtcatgtcaacagttcatcacatctatttggcatgaacagcatacctagggctatgcagtgggttggggatagatctggggttatttctgaggaggcctctgaggtcatagggatgatggctcaggtttattaagcactttctatttacctactaccgtgtagtgtggtgatctggtgggtttctgacagcagcccttggtttctagtccttacctttgcttactgcggacctggtgttggccatgcagccttccaatggtaactccagatgcctgattgtgaaggtaaatgacattatcaagcacttattgtatatccactgcttcccatcagtatcccaatatccctaaaaggtaaggacttatcaatccatcgcacacgcacttgcctagcaacccttcgtgtctgcccacactctggagtcccacatgccattcttgttagctcatgccaggatgggatgtgtgtgctcttctccacaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctggtgaggaggatgagcaaggcgggcaagcactccctgtcacccagcactggtgggaacgatcggtacagaggtcctcagagtgggcccgtccccagtgtttgtaaggacctaaggaggagagtggtgggaggtgaggtcagagaggtgaggagggtccattgcctgggggccacagagaggacgttggcttttcatctgagtaatttggactgtgggcagaggaggaacgtgatctgactggggttgggaggagaacagactgtgcacggtgagggtgagaggggaagcggaggcacccatgtgaaggttgctgcggcaggcccggtgagcggggatggtgggcccagaatggtggcagaggatataaggacaggattagctcatgtggggcactcaaggaagcaaagagccctgaatgacaccccacctccatcccattaccctctcttctctcccacagagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccagtgagtgagggaagccacaggatgctgatgggtgcacccagcgtgggtctgcggggttacagcagggaactgccaggctgagaggactttagcatgcatgaccacacctgcatccctccacctcccaccccaccacagcacacggggcctgggccacctggggcccctggaccccctgctcagcctcctgccacggtggaccccacgaacctaaggagacacgaagccgcaagtgttctgcac

SEQ ID NO: 137170 - DNA, 3388 bp, Homo sapiens
gagtgtggttgttcctgaagagggtggagcctttgagtgtgattgactgggctgatgctggctggagggatggggtttgattagtgaagggcagggctggggacttttgtgggtgggaccgagggtctttctgtgggactgtttctaggttggggtgtggcttaaggaacctgagcagggctttttggtctgggatgtgcatatggggtttcatgggtgggacatgagttggaagttgaccctgagctgttgggatggtgacttgagaggtttgagagcagcatttggatagggtcttgtgggtggtcttgaccaatgaggtctcagcaactgagggtgggctctcgggagtggggagtggggggtgtctgcagagtttgagagatcataggcatggcctccatggttaccatctaggtgtgtgcactttggggagtgaccctgggagtgtgagtgggaaatctgtggtggggccgggaccaagtcccttccagcatcccacatctactttctactcacttgagctccgaccaccctctccccacagaccccggtgctgctgacacccagctcgctgcctcctagcattcacttctggagcaccctgagtcccattgcgccccgtagcccggccaagctctccttccaggtaggatcctctttccccgttttggacagggtgagagacccaagaatggcccccatctgtgacctctccctctttttgcccccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtgatgctggaggctgctggcactttttctctgatgttgtcaggactagctgagcgtgacacgcatgactgtgtgtggagggtgtgaggcagaggtcgattgtgagagaaacggtgtgatggcgtgtgtgagaaacaatagtagggactgcatatcggtaaccatgtgtgtgtcagagacgtggaaagctgtgattgtgtgtgagagtgtgcagaagttgtgaccacagacttttgatggtgtgtctatgtgggaaattgtggctgtgtttcagaaaataactgagcctggatgaatagtcaaggtactgtacaagaacctgtgatggtatgcacaaaataatgtctacgagaagggaacggggactgcagccctgtcactgtttgatggcgagcaagacagactgggtgaccaaaaccacatgtgagagactacgtgggcatgaaactacagtagaggttgtcagggattgtggcaaagattgtgtaggtgacaaacctcactgtaggcgactcaacgtttgagaaatagatgatgtgcaaaactgtttacttgaggctgtagtgtcagctaaagctgtaagactgtatgggtgcgaacttgattgtacgggagagaatggctgggagaccaaaccagtgaccgagaccaaagatacaagaaggtgcaattgtgtgtacgaaagcaggcgtgagagactgcagcaaagactgagaaaaacgaatggctgtgactgggagagtgtgacaggctgtgtgtgtgtgtgtgtacacctgaaactagttgcaaatcgatttaccattactaccacagtctatcccacaggttcagggactgtgagaaagtaggagagaaaatgacggtgagccggacggagccactgacatggtgtgagagaccacatcactgggcatgcaagggagagggacaaggaactgtttatgagagacttggcagtagcagtaactggaagtcagaaactgtgggagaggaacttgacaactgagtgatgtcagagcaccagggggtctgtgaaacagttcataagaaaccataaatcaggggccatacaaaagagctgagcaaatgagacatgccaagtgaccacgtgacagtgtgtgagaaacttgtaaagctgtgcacgtgtgtccgtgatgagctgaccatatgaagaaaatgacggtgtgcacgactgagagggcatgggtgactgtgggtgacttatcgagggcctagtggtgattgtgaaat

SEQ ID NO: 137171 - DNA, 1052 bp, Homo sapiens
ttgccacgggggcctgttcctagggcacaaagttactgagagacccagagatccagtctctctgtggaacctccaaaatgccccagcagtcctgcctccagcctgttgcctggcagtatttgccagttgaccttatgcactgccctctcttctgtcatcttggcaacctgggccccccacctcaccctttcttccattccttttcctagacgccaccctttgaattgccatagagaatgggccaattcatggtggaggtttgttcattcccacaacaatcaaagggccctaaggtttacgctttcacacacccaatcattccccaggtaccccaaattacacccaaaccctaactcagccctaccttgtcttagcccctgcttgtaagtgttccagcttccaatgggcacagacctggatcccgctctccctagtcgggcccctattctaggttgagtccagccaccgccaatcaatgcagagccaggttcctcccctttttaactctggccgcagttcaaccctgccctctgaaagcatttcgtttctgccactcaatgctctttcgtgtgcctgacagccatcctgccctcctacctccgctgtgttctaaattcgtctttacccagctctatggtcttgtctaaccgtagagctgccctgcccgcctacgcggagcccagtccgacccactcccgccggctgctacgcccatttctatacaagccctgcttccgctgagcagcatggcgtgcgacaccgcccccttggtgttttggcaggggtctagaagtccctcgtccgccaatcagagaaaaacagggccacccacccccgtccttgggggctgtcttccatcaatcccatgtaagccaatcagtgtgaggcagacccccgcccccccgacacaggccccgagccttttcagttgctcacagtccgtcagtccttgagccaatcggcgtggagcaccgtgaaggccgaacgcgcctcctcgggactccaggggccgtgagcgttccatcatttccccttacgccaatcacggcaca

SEQ ID NO: 137172 - DNA, 1050 bp, Homo sapiens
acttttttttccaatttaacatcctatcttattgctctctgcttttccaacagtatttagtttcatttacccctcaaactgactcctacattgacagcacaataaaatccacattccttattatattaagaccctgtgtgatctaacctcttcctatctcttggaccttgtcttaggccactttccctccccactcaatttctaacactctgacctcactgcttctcaaacagctctttgttgcctcttgtcctttttgtggaaaaggccttcctactgcttaaccattaggcattcttcgattccttctcattcttcattcttgagaaaggccttccttgaccctttatatcaattaggattcttttgggcgagatctgatccaaactggcttagagaaaaggagtcaactgactggttcatgtaattcaacctccttcctctgctgcaaccttcccttggctcccatctcacttaaggtcaaagccagggtccttaccatggccttgtaggcttcacacagtttgtctccctcattacctctctgacctcacctcttacattcccccttcacttattcttctccagccagagtggcctctttgctgcacctcaaacatgccaggcacactcccacctcagtgcctttgtgtttgctgccccttgtgtgtggaacacatcctccatatagccacactactcaaaattcactgtctttaagtctttactcaaatgcttctccgtgaagccatccctgagccctctttaaaattgcagccccccactcctgtactccttattgtctctcatttttaatttttgttattgtagttagaaccatctgacacatagcttttattccattggttttttgttatgtctttctttacaagaatttgaagtccatcaggccgggagttttgtttgttgtgtttgctgctatctcccagtgcctaaaattgcctggcatacagtaggcatttaataatctttgaatcagtgaaaaccagatggtggcttggcatttccacataggaatgagccaggtgg

SEQ ID NO: 137173 - DNA, 1023 bp, Homo sapiens
gccacattgggagatttgtcttgggccatacataaaatacactaatgctaatgatagctgatgagctaaaataaaaaagttgcaaaaaaaaatcacataatgttttaagaaagtttatgaatttgtgttgggctgcattcaaagccgtcctggaccgcatgtggcccactggttgcaggttggacaagcttgatttacggttttgtgcagggaagggcagttgggagcatagatgagggatttgaaatgtagctagggaaggcctcccagaggaagggacatttgaatcatttgactgagtgacaaagccatggggctatctggcgaagagcattcctggcaagaggaatagtgtgcctggtatgctagtgaaactaccaagagaggtgagcttggtttcaatggaatgagcatgggggcactgagcaatacacttagattaacaacatctcacaagtgtgagtaccattgatttaaacttctttgttggttgtgttttgtgtttatgtctgttctacattcattttttccagagttgcctcccttagagtttcagtaatttttatcttttcaaacctttccagccatgggaaggactagcaggtgctagtggacccaaaagaacctcagacctgctgagatttctgattcttggtgttcagaccaattagcaaatagtttaattaaacggcctgctttcatggtcaacacaattctgaactggtggtcatttagaccaagtccactttgtttttgagacggaattttgctcttgtcgcccaggctggagtgcagtggtgcgatcttggctcactgcaacctctgcctcctgggcttaagggattctcctgcctcagcctcccaagtagctgggactacaggcacccaccaccactcccgactaatttttgtatttttagtagagacagggttttgccatgttggccaggctggtctcaaactccgacctcagatgatctgcccacctcagcctccctaagtgctgggattgcaggtgtgagc

SEQ ID NO: 137174 - DNA, 1664 bp, Homo sapiens
acgtcattcacccgcgccacccggaagccgcggttcctaccaaccgttcttattgctggcggcctgaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcggtgagtgacagtgcggggggcggggcgtttggaacattccacgtggtgggtggggcgttcaaagttagggccaaccctttgaattggcgggcgaggcgttcagagtccggccccgcgctccttggagcgagaagtggggacgacatccggggtgcagtttggctgggacgtggcgttcatagcaggggcgtgtcagcgcatgcgcggcctccgatgtttaacagattaaggcttgttttctggagccacagttctcgggttcgaatcctggctcggccattcttcatccttgtgaatacgtcctacctcgcctttctgtgccctataaactttactcttctgtgaaatggggagttttctggaaccttccccatgcagtggttttgagtttttgatgtgtcccatctttgtcaagaatttagcatggatgcctgaaacatagtagaggttcaatgagtatgaagaaatattattgcaatctttgttaatctaagcaggaaataaggtgttcagaactaggcctatgagcatcctaaaagggatggaggatttttctagggtgaggatgggacattatgattggagttcagtattgggagtataataatagtaattataactaacatgtatatagagagtttaccatttgataagcattattctagatgctttgtagtaaacgctcatttaatcctaatgactctacaaggtaatactgtcatctgtattttataaatggggaaactgagtcccaaacaggttatttacttgccaaagtcacacatctataaaggatagagcccagatccaaacccaggcagtctgacccagagccgaaaattaacttatgcactaaaaagccttttcagtgtatggtgacatgagagtctcagagggtcatgatatgaggtatactaggaggaatggggctgcctattggtcaccattgtactttcgtcccatcagaaaggtgctggaccatcgagacaaggtatatgagcagctggccaaataccttcaactgagaaatgtcattgagcgactccaggtaaagactatgggattgggtaccatttttttggtatgtgtgggcaagggagggaaatgggaagagagactccagacccaaccctgtcacctgacctaagagttcaccactgacccctacctctttttccctggccccacaggaagctaagcactcggagttatatatgcaggtggatttgggctgtaacttcttcgttgacacagtggtgtgagtgtctacccgcccctctgagcccacagggttcagcttaccccttccct

SEQ ID NO: 137175 - DNA, 1371 bp, Homo sapiens
ctggagtgcagtaacatgatcactgcactcaaagtgcagtgcactcaaagctcactgcagcctcaaaatcctagcctcatgcaatcctcccacctcagcgtgctgagtagctgggactacaggcgtgtgccattacgcctggctatttatttttatttttagtagagacagggtctcactatgttgccttggctggtctcaaagtcctgggctcaagcagtcctcctgccttggcttcccaaaatgttgggattacaggcatgagccactgcacctggcctgtgttacactatttttttgtggtctcttcctgtgcttcattaacctggtcatgccagtatttgagtgaattcatctcattagaactgacttttgaggtcagaggtgtgatactgcctggggaaggaggtcagcttgcccgcctgaagccccactaggcaggtgctgaacactataaggcctatagacccgcacacataaaggggaggagtacacatctctggactgaaggtggcctaacctcaccccatgacgggctagagtgggaggagttccctgtggccaggccagtgatttggggtactctgagacaagaggacatccttactgttggggaccactatgccaggtacatgagctgatcaggcagagatgccaggctgaggccattcccatatgcacagctgggggagatgcctttacaagcagttagcatgccacagctgttgtgacattcagttattcttttgtgaatgtcatcttcgtagcccctttgcagaggaatatcgataccccaacccttgggctaagccagataaagcattgcttaaagtgaccaaaggcaggaagtttaagtcccagagcctccaggccctccaaaagaggtggctgtcctattgaatccaaaccaggggacccctgttgagcttgctcacagctgcttctcaccaggatgcctcacagagaggaggtgggagcccaacctccacggacaaccagaaggaggagaggaccctggagaagaggatttgcaccctctagaggataaggcagcacaatactaccatgggagagtgaggaacttgaccctctcctttgccagtgatcacctgcaaagtcaaaaggacagaagagacaacaggggagggtcaagaaggagaggccatctcttatctggaggaggacacaccctctgtctcacacggaggccctgcctgtccttaagaacctagcccaggaaccaaatgaaaaagtggctgcctggctacagagaatgtattcgaaagaggcaacaggcccctctggcagacaatcagcctttaccacattaactgtggtttgccctccagcaaatcaacaccacgggccaac

SEQ ID NO: 137176 - DNA, 1004 bp, Homo sapiens
ggacacaaatggcaagctgatggcccacatgtgggtgaatggaggtgagtgaagcacagacaggggaatggatggagatgaacatcagcatgtgaataaaaggattgggattggaggaagagagaggagggcaatgaagggctaagtggggagtgaatggagtaaagaggggcagaagggtggtgaacagggaagagtagggcgaaatgggggaaatatccagtgttgtgagttactggagaagaaacagttgagtgtaagtaaacatgagtagtgttggggagagaaggagggagtagactggcagtgagtgggtgcagagtggaggaaattgggagtgatatgaggcacagtgtgaatgacagtggttaatggggttgggtgaagagcagtgcaggaaagtggcaaagcatggcatgacgctaatgaatgaagaggggaagaatgccgggcagtcaaggtgggaagactgtgctggaatgggaggcactctgtgaggtgagtgatggggatctgtggtgtcagaggttataggttcttggggtctcagtgatgcatgaccttgcgttggtggtgatggggagttgggtggaggtgggaggtgatccctggggtttctgcacaaagaggagctgcgctgaagaccctgtagtgaccacaggtgtatgggatgggatcagcctgtgttctagacagtgctcaatgaatgtcacttctgtgttccattcctgatgtggtttggatctgtgtccccatccaaatctcatgttgaattgtaatcccgtgttggaggaggggtctgatgggaggtgattggatcttgggggtggagttctcatgtatggtttagcaccatcccgccttggtaccatatagttagtgacttctggtgagatctggtcgtgtaaacgtgtgtagcaccttcttcctttcttcctcctgctcctgccatgtaagatgcctgttccctctttgccttctgccatgagtaaaagctccctcag

SEQ ID NO: 137177 - DNA, 1397 bp, Homo sapiens
gagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatcctttcatagcttttgaaaatgtgggtgtactatgtactatgtggatgtactaccttttcaaaaataaaacatttaaaaagctattttgttttactgttatagtaaagtcacagtctaggtacaggattttataacatttaatatagatatgctcaatgtagagtttatttttggtgaataaattgaagaaccaagcagatagaacaacagttattcaatcaattccagaggcacataggcattattttcctgaggttgccaa

SEQ ID NO: 137178 - DNA, 2018 bp, Homo sapiens
atcgcttgagctcaggaggtcaaggctgcagtaagctgtgattttgcccctaaactccagcctggcaacagagctgagatcctgtctcttaaaaaaaaagtttatatgataactgaagatcaagggtataagtttcgcagagttgatagaagtcaggtatgatgtataaatagacgtaagaaagactgaggtgtcagggtaagattgttcttggtaacaaaaagaccagcaggtgagagtttagtaaaaaactctctctccaggaactctgataaaatgagattatagtatcagctttcatatggcagaataattctaaagaaggtccgctccataatgtcaaagcataaaggtggtttattgtacttctttctagaagtctgtcaagttgatgaacagattgagaggcaacatcaggatgaccaagataaatgtctgctgatgcaagttggattttctgacaagaaaacaattatcaccaagagtgctcgtgactgtcatgagtttggaaacatacttcatctgagtacaaaccttgttgcttcaatacaaagacccgataaacacgaatcatttggaaataatatggtagataatttagacttatttagtagaagttctgcagaaaataaatatgataatggatgtgcaaaattgttcttccatactgagtatgagaaaacaaatcctggaatgaagccctatggctataaagagtgtgggaaaggtcttaggcgaaagaaaggccttagtctacatcagagaattaaaaatggagagaaaccctttgaatgtactgcatgtaggaaaaccttcagcaagaagtcacacctcattgtacattggagaactcatacgggagagaaaccttttggatgtaccgaatgtggaaaagcttttagccaaaaatctcagctcattatacacttgcgaactcatacaggagagagaccctttgagtgtcctgaatgtggaaaagccttcagagaaaagtcaactgtcatcatacattacaggactcacacaggagaaaaaccttatgaatgtaatgaatgtggaaaagccttcactcagaagtccaacctcattgtccatcagaaaacccacactggagagaaaacctatgaatgcactaaatgtggagaatctttcatacagaagcttgatctaattatacatcatagtacccatacaggaaagaaaccccatgaatgtaatgagtgtaagaaaactttcagtgataagtcaactctcattatacaccagagaactcatacgggagagaaacctcataaatgtactgaatgtgggaagtctttcaatgagaagtcaaccctcattgtgcatcaaagaactcatacaggagagaaaccctatgaatgtgatgtgtgtggaaaaaccttcacgcaaaagtcaaaccttggtgtacatcagagaactcattcaggagagaaaccctttgaatgtaatgaatgtgagaaagccttctctcagaagtcctacctcatgctgcatcagagaggtcatacaggagagaaaccttacgagtgcaatgaatgtgaaaaagcattttcacagaaatcatatctcattatacatcaaagaactcatacagaagaaaaaccctataaatgtaatgaatgtggcaaagccttcagagaaaagtcaaagctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccctataaatgtacagaatgtgggaaagcctttacccaaaaatcaaaccttattgtacatcagcgaacccatgcaggaaagaaagcccatggaagaggccacactcggaagtcaaagttcatggcacattagagagctaatca

SEQ ID NO: 137179 - DNA, 1034 bp, Homo sapiens
tgcacacaaactactcaggaatctaaaaaaaatgtgaatataaaaaggcacagttggccaggtgcagtggctcacgcctgtaatcccagcactttgggaggctgaggcaggtggatcacctgaggtcaggagttcaagaccagcctggccaacatggcgaaaccctgtctctactaagaatacaaaaattagctaggtgtggtggcaggtgcctgtaatctcagctactcaggaggctgaggtgggagaatcgcttgaacctgggaggcggaggttgcagtgcgcagagatcacaccaccgcattccagcctgggcaacagagcgagactccatcttacacacacaaaaaagtatgattggttaaatcaccctctggagagaaggggactcatcttcacagtttgctaaatgtccctagggaagtttgtctctcattctttctctttccaccccttcctctgattccctttctcctccctatgtatttatatcgaattggtcatttttcctctctgttgttcctggttctttcttggtgctttgagattcattcttttatcacttcccttgtgttagaagaacttcctttaggcattttcttaagagtaggtctgccagagacaaattctttcagttttccttcacctgaaatgtcttaatttccccttcattcctgaaggataactttgccagatatagaattggtggtagacagtccctttttgttagcacctgaaaaatattatgctacttttttctagcctccatggtttttgttgagaaatctgctatcattcaaattgtttttttgttgttgttgtttattttttgttttgattttttacctataggtaatgcattgtttttctctggttgctttcaaaattttttctgtttctgtagttttcagaagcttaattttgccatggcttggcatgaattagggatttggtcagcttcttgaatctgtaggtttatgtcttttgccaaatttgggaagttttcaggtattatttcttcaaatactcttgtt

SEQ ID NO: 137180 - DNA, 1063 bp, Homo sapiens
tcttccagagagcagtctgatggccagctgatgtgaggggattgctaggcagctaattctgggcactgaaagtctgatggggtctcctcatctgctgtactcttctccacttgttccagctcggccgtcacacatctctgctttttcccaagaagagcaggaaatggccaaaccccaggtaagtatgttgtctgtttcttcattcctctattttactgtggatgtgacgaaatatgtggaaatccctgccataaaataggaaagtatttgtaaataaggattggatcaggcaaaataagagacaacagatcaaggccaaattagaatgtagaggtgtgcaggactcagggtgtaacagatattgatgttgggctgtcagtttctctttgagccttctggtagccaaagggaaacataaccagtaccttggctcaccttactcatcaggagagagcacacagccttcatgggaagtcaaggttgcctggaattgtgtttaaaggtatttctttgctgggtcttcatgtggatagtgcagttgccctcaaccacagcctggtgacaaatgctttcctgcagatatgtgctacagctttcctcagtgagctggagacatcatgtcaaaatgtaacttgggaatgaaatctcttagggaacctgcttgtctttccaatgattttcctgaagcaatttcttagtcggactttgaattatcttttgtccaagagacaaaattttttcagatacctgcagcccaccatattttttctttcactttaaacatttttattttttaaattaacatacagtgaaattgatttttgttagattggtgtaactaatctataggatagataatagtttcatcaccccaaaaaaactccttcatgctactctgttaatagtcatgtcttccccaacctgtaacctcaggcagcggtaggtctgttctgtgtcactgtagttttgtcttttcaagaatgtcatataagtgaggtgtcatgtattatgtaaccttttctttctgagatgattgatttacatgcaattgaaagaataatac

SEQ ID NO: 137181 - DNA, 1075 bp, Homo sapiens
tgagcagcgagcagaaaatctgttatcgagagagagtgaggttgagggggcaagtgctaggggtcgtgggctgagtgatggggagttctgtgggatgagtgaagtgggagttgggggttgagtgatgggggaccgagaggtcagtggacgaggttctaggggctcactggtgaacaaagttatgggggctaagcaggattaaatggggcttattaaactttgacttttacacgttttccagcacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgaggtgagcagaaggaaggagaggcacctgcgaggtctcacctgaccccgggcctcgcccaagttgggggcgtgggaggaggggtaggtgcggggtctgagggagatgggggtaaaatgtaattgggataatagttttagagtgtagttttttttggcatttaataaataacatttgaatatatagattaattctgaaatagagaaaaagaaaatcaacaggaactaattcttcccccacacatttaaatgtccgtttttagacatttttggtgtgtataggggtatgccttttaaacatttaacatataactttaaaatggattcccgcagttttaaaacctactttgtaattcaccttaggatttttttgtacaccttttaaaaacgtttagttgagatacatataccacaaagtgcatagatactgtacagttccatataacgcttttaacagctttgtagcattttatcttttatattttgttattattaatcccttatgggtcatagaggatcgtttaagtttggcattattgaaatcaatgctgagacgtgggtacgtgcagagaaattatgatacattatgataaattatttccttaaggaaaatacctacaaatacactttatgggtcagtaca

SEQ ID NO: 137182 - DNA, 1058 bp, Homo sapiens
catctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggtaggtgaggagggagcgtgggctgcggggatggtgttcctgggggcctgagatatgagtaggggtcctgggagggggctcggggttccttggagacattttagcactagtggggaatggaatggcgtgtatggggaggtcctttttgtaccctgatcccaggaagtgaattcaggtgtgggtgggaggctccggagggtgctggtggtgggggatgggactccttgagaccctccctgtcccaggaacgggattcaggacttgggaaaaggatttcctgagccagtttgagctctaatggggaccttgaatgggggtttctgagatacctccttcccaaggagtaagcgcgggagggagctggggtttcttcagagacgctgtacctacaagacaggggctccaggctcgggtggggattgcagagacacccccaccccaggaaactcggtaggccacgggagggggtctttgatgaaggtctcagaaatagctcttcctccggaggggaaatgagggctcgggccaggttcctgagacaccccacaccccacacctaggaagtttctcaagtctggcagtgtctccaaattgact

SEQ ID NO: 137183 - DNA, 1991 bp, Homo sapiens
gaattgaaatgagttcctaagggttaggagctcagaatatgcatccagttggcagacagtaatttgcatctggaaccttagcagtaagacagcctggaaaatgtatttagtgtctgatctgtgtggtacaagaagatgcacagagccagatgggacccccctaacgctgttcctcttgccacagtaaccggtctccatgatgttgatgagtatatgcaggcccagctcctcctagctgtgagtaaccctggccacccctgacccactttggccccctcctggctgtctccacctcagcctcagccgtctgtcctgcccacaggctctgaacattgctacacatgtcctgaagccagggggctgctttgtggccaaggtaagtctcaaggaacttggtggagtagagggaggtcgctgagggccaccctcacccgctgtctttgccttctcaccctgcagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacggtgagagctggagcatgggccaccctgggggactctgccacaccttatgcaatctaggtcccatgagggcccacagtctcaccccctgggggaggctctgtcccctcatgggaatttttttcccaaggggatccttagccccattctctgatggaaatcccacccctttatgggtattttgtcccgggaggagcttcagcccaggcagtcctctagtggtaactcttgggcctggtgaaaattccatcccaggaggatcctgagccctgccccagtggagactccacctgcctaaggacattctctcctaggaagatctcagtcatgtcccaggtggaaacctcctcggtgtgaaacttttgccccttaagcctctagcaggaagagacagagcctgcccctgggatgacatttgagtgagggagacgtcatccaggcagcatataatccaatatcaggtggacataaatgcagtgaaaaatagcagggcaccgatgttttagaaggggtgattatggagggcctccccgaggaggtgatctgaaccaaatgaaggatttctggtggggtgggaagagagtagctggtggatatgtggggagggtttggcagccataccgccgcctgtgtcatgactggccccaggcatcctgaccttgtcctcagttgtctccccctgttcctaagacccagatttcaaccagctggatggtcccacccgcatcattgtgccttttgtgacctgtggggacctgagctcctatgattcggaccgcagttacccactggacgtgagtgcccaaccaacagtaggtgggtgggagggaggctgtcctaggttaccaggtcctcaccatctccctacccctctgtccctgcagctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaatat

SEQ ID NO: 137184 - DNA, 3720 bp, Homo sapiens
gtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtgtgagggcacgtggagtggggctgacatgagtgggggcagagcccatgaccaatgggttctgtgtgtccaagtgtgtctgaccgtcaactccatgactagacagagactgtggttggctggctggctgacgaagcttggctctgtgactctgtttgactgacactccaacacatactgtctctggctgtccatctgttcagctgtctcgctgttagaagcaagtcatattaactgtcatggagagtgacaagtatgtgttggttgggtgactttaacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttcagaacctatgctttttccaacgcaggatgctgcctgtttttgaccatgtctgattacaactagtagggggggtgtgtgtgtgcacagcagggtgtttgatggtctctgtgcccagctcagggatttttggctgtcctgtagtcgctgagtcaggttagagcattgcaaggctgggagtctgataagatttgtgtctggctgttagagggtgcaggtctgtgaagtcgggcctctgatggtggctggctttggccgtctggccacgtgagcctgcagggccatgccatattataggatagctcatgcatccatttgagccacataagactaactgcctgagggtggatgtctgtgtgtgactatcatagttcaccttttttgtggctacatttcatctgtcttgtctgaacaattcagaccagcctccagggcctctctgactctcttttctttcttctctgctgccttcctgacccctgggggccctaggggcaccatggtaaggtgagtctacagagcggggcccaggatgctgacatgtggtggggtatcatgttgggacctgaacgtgatgcctctcacccctgcccctttctccccaggtggctgcgagcctacgagagtgctgtctccttccacttcagcaactattttgtgggctttctttccgaggccacggccacgttggcgggggctggctttaccgaggagaaggatcacctggaatggtgggggggcttggggaccccctctcccacagggtgctgcctagaggagctgcagggaggagggcgggtgctcccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaac

SEQ ID NO: 137185 - DNA, 1065 bp, Homo sapiens
ctcttcccctccagatgttttcaagaatgctctccgcctggggaccttctcggctgtgctggtcacctatgcagccagcgccctcctacatgtgagcagggtggagcaggatcagggtggaagctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccccttacctctccccaccaccctagtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttcccccagtgaacatccgttgagtgcctgttggtgctctaggtgctggagacacggtgaatgaaacagactgaagtcccagccctatgggacaaacattttaaccgggcagacagtagataaaaaatgagtcagtaaagtctaataatagtgtgtcagattgcaagtagtgctaaggagaaaatgtgtagggcaaaggggacgggaagtatgggggtgatttccatttgaaatagggaggtcagagaagcctccctggtgaggtgatgtttgaggcctttaaccgaaggaggtgagagagggaaacgttccaggcagagagacacccagtggaaaggccctgaggtaggagagggcctggaatctttgaggaatagcaaggcagccagggtggcttgagcagaggtagggtgaggag

SEQ ID NO: 137186 - DNA, 1659 bp, Homo sapiens
cgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggaggcctgattggctggaaaactgaaggatccccattctgattggttgctctgagtgggacacagaggagagaaagcaagagagatgaagggttggtgcctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtgagtgccctccacccggcccct

SEQ ID NO: 137187 - DNA, 1077 bp, Homo sapiens
cctgggactgtaggcacgtgccaccacgtccagctaatttttgtatgttttatagagttgggggtctcactatattgttcagactggtcttgaactcctttatgcaagccatcatcccacctcagcctcccaaagtgttgggattacaggcatgagccatcgtgcccggcggtctttttctttctgattctctgctcactcttgtattcactcatctgttcacctacattctctctctctcattggctacttcactcactccatcatctacacctgcttccttttataccacacacacttcttgagtaccaatcacagccacactgttttgtgtcaggctttacacatattaccttgttttagagaaataaaccactagaatccaaacagttaccccatttcacggatgaggaagcagacgcatgggaaggttatgaagtctgtcttcttgcagggacccccagctctcacaagtgtgtgttcctttcactgcctttattcttcatatctctctcttcttttcttcagggaaagagtatgccaagggagacagccgatacatcctgtaagtgtttgcctctgtcaatggagactggcattggttttcggggggtggtgagttggggagcactaatgggctaacctgtaggaagagcacaccgataccagtgtcccctcatgctttctcctgcaggggtgacaacttcacagtgtgcatggaaaccatcacagcttgcctgtggggaccactcagcctgtgggtggtgatcgcctttctccgccagcatcccctccgcttcattctacagcttgtggtctctgtgggtaaggaaagggcactagaggggcactgggcactagaggggttgatgggggatccacagacacagatgtatccctgtgggtgggatctctcaacggtgcccttccaggggtaagtcagactgaatgacaaaccccctgaggctctggaaaggtcatgcccttctctgagcctgcactctcaggtggggagggttcatttttcttcctcctcctccttctccatcacaaagtctcctgtgaaggttacatgag

SEQ ID NO: 137188 - DNA, 1451 bp, Homo sapiens
tacaggcatgtgccaccgtgcctggctaacttttgtatttttagtagagatggggtttcgccatgttgcccaggctggtctcaagctcctgagctcaaacagtcctcctggcttggcctcccgaagtactgggattacaggtgtgagccactgtgcccggcctcagtcatcttgtgttattaaattgttagctttctttagttctagcgatatgagttatctttagtcccagaatcctaagctgtcttggatttgaggattttgaacttccttaaatctgaaggtgtgagctctcctgagttctgaaattctcagctctctggtgtctggaatctcacttttctgatttctcagattttcagctctgtgatttcagaatacttagctctgagaccttgaatgatgacttggaaagtgctttggaatagagaattggcgaaagtgtccccttcctcactggggcttctccttcccctcctgccacccacaggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaacactgagagatccttaattactaaccccagagatgcgctatgactgaccccacagatcccaccatcattcacttattccagacccccatcagcatctaaagacctcccacctctgacctcacaaacccctatcactgaccccccgccagaccccataactcactacacagaccctatcactggccccacagtcccctggtcttaactcgagctgccataacagaatgccacagactaggcttaaaccaccgaagttcattttctcacagttctggagtccaagatcaaggtgtcagcaggtttgacttctcctgaggcccctgtccgtagcttgcaggtggccaccttctcagtgtcctcacatggtctctatgaactagcgtccctgtccctggtgtctctctgtgtgtccaaatttcctttttttttttttttttttgagacagggcctcgctctgtgtcaggctggagtgcagtg

SEQ ID NO: 137189 - DNA, 1095 bp, Homo sapiens
ggctcacgcctataatcccagcactttgggtaggccaaggcgagtggatcacgtgaggtcaggagttcaagaccagcctgaccaacatggtgaaactccgtctctactaaaaatacaaaaattagctgggcatggtggcaggcacctgtaatcccagctactcgggaggctgaggcaggagaatcacttgaaaccaggaggcagagtttgcagtgagctacgttcacaccactgcattccaccctcggttacagagtgagactccgtctccaaaaaaaaaaaaaaaaaagcatatacggcatacctgttccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtagtagtagtactcaaccgataggactgaagtgactattgcatgagtcagtattggcaaagaattcagaatagttcctggcatacagcactgtggaagcattagctagtattattatttcttatattgctgttgagcgcttgtcctagtgcttggcacatagtaactgctcaataaatattactttatatcattaaaatattagaggctgcccagccagttcctgagacatctactacaaaagaattgttcatggtttgattttgttttttacatgatttggatgatacaggaagagggactgggagttgtttgttcccctgcaggtagcccggcttcagtagaaggagaggaagccggccctgaggtctgggttatcatccccattcttatagcactttgttctgtttgcccaggcccattgctagaagactgggacataatcagccccaaag

SEQ ID NO: 137190 - DNA, 1029 bp, Homo sapiens
aggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcct

SEQ ID NO: 137191 - DNA, 1052 bp, Homo sapiens
tctctactaaaatacaaaattaaccaggcatggtggcaggcacctgtagtcccagctactcaggaggctgagacaggagaattccttgaacccgggaggcggaggttgcagtgagctgagatcgcgccactgcactccagcctgggtgatggagcaagactctgtctcaaaaaaaaaaaaaaaaagaggtggcagtctccttaggtgtaatccaccagcccgggtgtctggagggagacaggtggaggactgatttcctctggctgcctatttctttcccctgcagggcccttgctgccctgatcctagtcccccagacatgtgtaccagtggtttggatgattaatgcaatgaagggggcaaacaaggacctccccaaggcaatataggggagaggtgagagccagaacttaaatatctttttccctaacctatcctctatttactgcctctggccatccgcccgtcaaaacacacaccagttaaagacagccttccatttccccatgggtctctcattgctatgttgcaatttctggaacccatgtttccctctctagtttctccagagttggtttcgggcaaaggaatcagtagcttgtgctgtctgccatctttgcaggaaccagaaaccccaagtatcctagaggaatattagaggtttctgcctttcagggtatctgagcctcctattcacagaaaggactcttctatctctcagaggtcccaaactactatccacagaattggcttgtctggtccttcaaacacctgagctcataaatcacagaatgcatcccagagggtattagctgtttactgacaaaagagacatttcaggacctcagaaggccagacactcccataggttggatggccctttggggagtctgagcccatttccacaaaatgcattcgttagacccacacacagtgcttgagccccctagacacagaatagtcttgtcctgttcttcaagtgactgggctatcatctgaggaatagtcagcttccccccaatactgggggtgacgggagacttttaagggtc

SEQ ID NO: 137192 - DNA, 3499 bp, Homo sapiens
tccctgttttttgtgctcctccgagctcgctgttcgtccgggttttttacgttttaatttccaggtaagttgcatatgtcctgcgaaacggcggctcctcgccacacacgcgccgcgccggccgtgaccggggaatagcgagtggggagagtaatggccactgacacgtaggcttggctttctctgggacgggcgggtcccgtgcttggaggtgaaacatttcggttggtgggaggccggcgcgctgtatctgagtgtgaggcctaccgggagggactggtggcgtcggtggtggcagtgaccacgcgacagccgacacttactttccttatcccacgtggccgccgccatcttgttctgccggcgttaagggaacgcagggatgttctgggcttgcgcagtggcacaaaatgacgggcgtggcggctatgaatgtgagagcatgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttctcacatctccattttctttctccttcctgccaccattcttcatgttcttcccacaggacttgaactgccatgtcctctgaagaaggaaagctcttcgtgggagggctcaactttaacaccgacgagcaggcactggaagaccacttcagcagtttcggacctatctctgagggtgagacgggccatactcacaatgggggttggtgagagaaagtctgggatccttgcatttcaaggagtattaactgaaaagttaggacccacgcctccaaattctttttcttcctaagcctatggtgtagactaaggatgaggggaagcgtctttgggattagtgggagcgctccgttttccctacctatgccatctccttttccggccaccctttgctacttaacctttggggtactgactggtccacattgctccatcttctctccctctcacagtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtgagtgcagtgatcgttttgatcatggggtgagagggagagttgcctatgtgtggacaactgccatttaaatatttttctgctctaggtggtggggaccagggctatgggagtggcaggtattatgacagtcgacctggagggtatggatatggatatggacgttccagagactataatggcaggtgggtagccaaagggctgggatgttctcctattgcttccctctccttaagaactcagcgcctgggtgttcatgcataccacaccttgctgttactaatgtgtacctaaaatgagtatgaaatttagcattttaagttaattgtgtagtcatatagttgcgacatggtaaagtatactatatatgttgtgctgtgtgggttatataactatattgctttaacatgtaatatgatttaatatactgcgtataaatcgtatgccataaaactgtttactgtgatactcatatgcttaacatatcctgtttttgatacgtaaggtttatgttatgacccatactgtaaaatgtgacgcatataattacagtggtatatataatgcagtaccagaaaacttttgtgtgttttttttcccccccagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccggg

SEQ ID NO: 137193 - DNA, 1654 bp, Homo sapiens
gtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatcttttttggtgtgtgtgtgtcttgggtggtaaagtggtaattttgtaattctagctggtcttagttcctcagttctgctccctttagtcatggttctttctagtggctgtattgaggccccatgggtgttatccctccattggttctagtttggaacagaaaaatctgttgtattcatggctttcacctggctaatactgagctaagttaccaccaggttgcaaactccaggacattattgtcctgagctgcctattcccttgctggtgcgttgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttg

SEQ ID NO: 137194 - DNA, 1041 bp, Homo sapiens
acccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgca

SEQ ID NO: 137195 - DNA, 1006 bp, Homo sapiens
tggccccaccgtgtcagactccagggtagattggtcagagagcaggggaaggacattagaaagtctggtgtggcccggggtgtagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccgtaggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacaggtaggcagacagcaggcctgcatctgggtgctcgccctccagccctcccagggcacagccctcaccctcacctttgccttccctccctctgctgctgcagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacaggtgggtcccccatcagggcctcctggagacggaggacctgcctcctccagcacactgggacagtagctcatctcctccatc

SEQ ID NO: 137196 - DNA, 1058 bp, Homo sapiens
gggtggcgttgccggctcggggccccggcgtccgaggccccggcgccgggagccggaagctcggcgcggaaaggatgaggctcggggagcgcgggcctggtgcgcggggctgggcggggctcaggggagggggcgcgcgcctcggaacgcagcgggcctggggctaagtggggacgcaggaggggggcgcgcgctgcagatcgcggccggaccggcgcgcgcacgcgcgggggcttgtcgaggaggccgcgcccgcgcgcgggaaaatcggcccctggtgaccgttacccattcggtgtccacgcgagacgccggaaggggagggaagataagggggacagacccccccttcagagtgcggggactgagaactcttctgggggaaagtatcgcctctcggcgtgatgggggaagggtttggaatagaggatctcccagaagagagaaatggggccttcctaataggacagctggactcccccatgtgcagggaaagaggggtgactcagttatgttggggggcccctctatgtgacgaaagccgcagggaggatgggttccacaagtgggaggacctctgaggggttcaggagagtccacctgtggccagttccggagccagcagctggagggtgttaattgggaccacttaagtggggtttcaaatgcaagtgaaggaaggggtttgcgaggacaggctgtagggagaggaaagcgtgggcacaggcgggctcagtctccacttggtcttgcctaagtagggggggtagggcttgcacacgaaataattttgaaaagctcttgtacgtttttaggttgacatctaaagtttaggtgtgatttttgcaatgggaggcagaaaatattaaacattttaaaaagatgatataggatgaggactgactgcccttggaatgttttgagacatgatttgataaaatggcttctaaagtactttgattaagaatgtgccttgaatcagaaagaaatctgttttttaaaatccgtgtgtcttacaaaattttggcagtcccagaaatataccaggtatatttaaa

SEQ ID NO: 137197 - DNA, 2459 bp, Homo sapiens
cttgcgaatcttctccagggtgcggacgccccagccacgcccatcatccgtgcggaagatgcagaggtcatatcggatacccttctgtaccacacgatttgggcagtcatagccgcagcggcagcgggagttgcactcgtagatgggcagcccggctcgaagccgcacctggccctggtcattgtaggcaaacttgtgcagtgacgcccccgggcagcagcctccagtgggtgcccacagacagtcctggcactcgcagcccacagccacctggttgagggtgatgccctcaccaacacggtactcattgatgtacacgaaggcccgcggagggccgtccaggtccacctcattctctacagtgatgcgtcccagatggctgcgcttggcattgagctcctgctcccagcgacggagcgcccgcctctgcttggccttctgcaccaggtagttggccaagcttgggtccaggtgccggggggtctttgaccggtggtgccgccggagcagctccctttctaagtccttgtggaactgcttgaggatacgcacacacttgagattctgccgtggctcccaggtgctctctgagtctggatatccacgccatttcaccaggtaatattcctgttcctgttgggggtgggtagggggacgggggtaccgtaagtagtgagatctttgggccagccttcatggggcttccatcccaaagctgatggataacacctaccccaccccaccccttttctggaatgacttcatgcggtgattaaaaagcatgggctctagagtgaggattactaggttcaaatcctcctctcccccttactgtctgtccaaactgttccaacttttaattaatctcccaaacccactcctctccttggtcttccccatcatcagctccctcccttctagctgttcagaccggaactcctggagtcatccttgacttctcttttgttcacacttccgacacccaccctctgcacatcccgttggccccaccttcaaaatacgtccagtgacaaaccatcatcactgccaccaccctggctcacctggaccctgacaagtccttgcctgttctaggcagcttacatgtattattaactaacttaatcctcacaaccccacatgaggtagatgctcctagttatccctcttttacgacaaggaaaatgaagtactgaaggtttgggtaggtagcctggggtaacacaaccaggactggaacccaagcatgctgactccagtttgttctcctaaccatcctgccactcccccttctggcaataactatccccatttcagttgttaggggattaaatgagtttccgagaggaaacgcctggcacactgaaagtgctcaatagccattagctattgacatttccactccagggttcagcatctcaatctctgcaattactttgtattcctagggagatgggaagagatttatttgggaattcattccggctcctgcccagaaagctacttagtttccctatctgtaacatagggataaaagggtctattcatcctgtgttttcagggtcaaaggagaaaattccctttggaaacagatgtgggcagttggggacaagagggcaggacactaacttccttgtgacctgtcccctcccagagcatggtcaccccagactcacgcggatcttcttgtaatcgcacaggtactcgacttcaaagtcatagaggttcctcttagagataccgagggcagggcaggagagcttggccaggcggcacaggtcctgcagctgattccaagaagacttgcaacacacgctgcagcctggatcaagcggggcagaaagaactattactgggcagcctgactaggccaggagtcaaaggggaccccaaatcctccctgggacatcccaaagactgactaagagtcagggaaatttaatccacaggccttccccagtgctgagactgttctacaacagaaatgtgctttgaaccccaatactcactgcccaaagctgcccctggagcagcagacctctaagcggggtttgcaacatgaattgtcctaaaggaatctatttccagagcttcaaactccatgtcattcctaaaactgcctgcaaacctgctttgggttcaggacctgatcacccctctctccactttgcaaaagaaagagaacaaccccccatctcagtaggatgcagtgccccgaggtggggcggatgggaggacaagattaaaacctccagggcaccaaacaaaggcgtaactggaaagactggtctttaatcccttatctcaaactcctgggccagatgtgttttggaattcaaaattttttggattttacaagactagttctaggatatcccatacatcacctaacacccccagcgtggccaggggacatcaagctataatcaaatgcattaaccgtcctgcagcaaaagtat

SEQ ID NO: 137198 - DNA, 1451 bp, Homo sapiens
cctcttctcatttcacaagggcccatcttatcaccaagcagtatctgcctgaggagcattgttttaccagtctgcacagaaggaacgcagtctggagtaggatgagacatgccttggacaaaggttggctaactcctttagactttcaggacactggggaaggccgagtgtattaggcaagccagccattgtaaaaacaaccccctcatcttagtgactttgcacattacaagtttgcttgctcatggaacagtccattgtgggggtttgagtgggtatcctttcacacagcaactgggacacctaggctctttccctcctgtgcctttgctgtgccttgaagccttggagtcactaccagatcctcagcattgcctggcaggcgggccaagtgggggatagaaggggcccatcctagtgggccaggcctagatgcagcacccatcacttctgcccatgctccactggctggaactgagtcactggccttacctccatgcaagagaggcaacaggatgtgctttagccatgtgcccagctgcacaaggctaaagcacagccataactagcaactagataactagcaagtatctacaacagaaaaatgtcgcattctaagatgggatgcagttagcatttgggatgagatgatttttcgttatgtagaactgtctcatgcattgggggacatttagcatccctggaccttgaccatttaaatccatgagtgtgccctgtcatagtgacaaccccagatacctctatatatagccataggtcccttaggggtgtgatatagttggaaagtgacagaaactggcctgaggaacactcacatgagggtgtccacactgtagcactgatactgatgacaaggagaggctcctactctgagaaactgtacagagggtcacatctgacagggacagagacaatcttgggtagaacaatctacaccacagaggaccctgacagtctgggcaaggagacagccacaccctgtccagataaccctgctggcctgctggaggagatgtctacatgccacaggacctggccatctggaaggaggaggtggggaggtgtccacaccctgagggctcctgacagtgggcgggggaaggagtcctgataatctgcaggaagtccatgtcccacagtgaccccagtgacctggaggaagagcttgtgctctccacactctagaggacctggtggtctgacttaggaagtgttcacacccatgttgtcatgacaggaaaaagaagtgtcctcaccccagagggatccggacagcctggagatctagtctacacccaagggcaccctgacagtatcgggggaagtgtccatgccctcaatgtcctgacgctctggaggaagtgtccagaggttgaaggaacccaaactctctggaggagatgtccagaccccataggacccagacagtc

SEQ ID NO: 137199 - DNA, 1053 bp, Homo sapiens
gatacttcctgctctgtgcagcccctaggacggtggactgtctgggtcctatggggtctggacatctcctccagagagtttgggttccttcaacctctggacacttcctccagagcgtcaggacattgagggcatggacacttcccccgatactgtcagggtgcccttgggtgtagactagatctccaggctgtccggatccctctggggtgaggacacttctttttcctgtcatgacaacatgggtgtgaacacttcctaagtcagaccaccaggtcctctagagtgtggagagcacaagctcttcctccaggtcactggggtcactgtgggacatggacttcctgcagattatcaggactccttcccccgcccactgtcaggagccctcagggtgtggacacctccccacctcctccttccagatggccaggtcctgtggcatgtagacatctcctccagcaggccagcagggttatctggacagggtgtggctgtctccttgcccagactgtcagggtcctctgtggtgtagattgttctacccaagattgtctctgtccctgtcagatgtgaccctctgtacagtttctcagagtaggagcctctccttgtcatcagtatcagtgctacagtgtggacaccctcatgtgagtgttcctcaggccagtttctgtcactttccaactatatcacacccctaagggacctatggctatatatagaggtatctggggttgtcactatgacagggcacactcatggatttaaatggtcaaggtccagggatgctaaatgtcccccaatgcatgagacagttctacataacgaaaaatcatctcatcccaaatgctaactgcatcccatcttagaatgcgacatttttctgttgtagatacttgctagttatctagttgctagttatggctgtgctttagccttgtgcagctgggcacatggctaaagcacatcctgttgcctctcttgcatggaggtaaggccagtgactcagttccagccagtggagcatgggcagaagtgatgggtgctgca

SEQ ID NO: 137200 - DNA, 2450 bp, Homo sapiens
ccagggtgagcacaaagggctggggtctgggaatggcaggcagcaagggcttccctctcgcctcgtcatcccatagtggggaagccatctcccccacccccaattcttggcctgtactttgccttctgccacatgggccctttcctggcatccacctccgtggttttcaaggcttccctgagacaatccacgtggaccaggtgctctacccagtgcctggcacctcatcaccaccccatcaatgcacattcttgtcctaagtgctatctacggactatctagatcttggttccagctctgagtggtgtcagcggtcatgacaccccaggtcagggcccctagcaaccgcagagctcccaagagccctaggtaccttcactgcactgtgaaggcagagcttggtcccagcctacctccagggctggccagctctgcactgccttcctctcactgctcagtggcccatggacacccacttcccttccagtggcatgtgggcatccacttctcagatatgcagccctgaagaagagaccctacagctcttagggccaacactacccagcactgtaagcacgagcagaaaccagcctcagcccgtagcccagggaccccctttctttcactagtacaaagtttctgtggttggggaaccagcttcatgtcgggctaggcactctggcctctgatgtctgcctgctctggggttgcttccccatacctttggggcagcagggaggaggcctgcagcagacccctcaatctccaggcagaagcaggtgcaaaaacaaatatattctggggctgggttgggactcaccccttggacctccttaataggccatgaatcccaacgacagagagtcttgatgttgaaaaactatttctgaaggtgggtgggggtttgtaagtgcaacccacagatggggctgggacagggaaaggggactcctggagtcggtcctcaccacggccacagccctgaacgtagagcaggtaggagcaggtgggggcaggtggaggcaggcgaggccctggcagtcattctcgacaggagggcagcagtgggggaggtgcatgtagcttcaggccccctcagtcagtctggcctcagacttctaagggctagaagaggtatttgcggcaggactcagtcccacacttgcattcaatacggacccgcttcttaggggagccagggagcccagccaggccaaagttggagtccatgcgggtgctctccatgtccacggggtccactgtggagtcacagccagggaggagaggagggaaggaggcagggagggagggggagaaggagggagggaggaaggtagggaaggaggcaggggacttgttagaaggcctggatgaagggtcccactaccctttataccatgagaccaaggatctttggggctgggagcaactctgggatttgagttgggagatcttagggttggtggtttggggctagggccagggctcagcactggaggttgttcaggccaggggttgaagaatgctgggggaggcagggagccgtcaaggaaccaggagggtcgttttaggtgtgtgggggggggcaggggcaggaatagagggccacctgggcatccagaggtacatctgaactctcctgccaaagacctgcccttgagggtctcagaggtggctagcttatcaaggaggggactggctggaggccacaagggtgtccagaggcttgggatgaagaaggccaaagggagctaggagtggggaggggctgggggatgagggaaactcagtcaagactggagtcaggagtttcttaactctccaggaatcttgggagaagttggtatgaatgcctcagggttagggttcaggggctgggaatgaggggactcgaggggtaggcaggggtctagtagtccgaatgggggactgggagtcaggaagagcatcttaaagctcccgctaaagaattttccttggttctctgagtgactggtgtgcctttgggaggggtccttgtgtcccaagtcacagtgcgcccctgcccccagtcccttgccacccccaccttgcatgttgtaatcaaaggtgagctcctcgcctgcccggatggttcttgtggcaaagaaagcgatgcggggcagccgctcgtcaaggttgtctatgaagacgttgtacacctgcaggttggggtcacactgggcgagaaagaacagttgggagagtgaggaggggctccagcctgcccctctcgaccccttgcccgcctgccgggggtacccacactgtggttgacaaagtgggagatgttgccatagtaggcggcatccacggtgtacacgtcctccacgtagtccaggtcaaagaggtaggtggcgccctgacggtcgtagatctggccccgccgctctgcctcctctgaggtaatgatctagggaaagggccatggg

SEQ ID NO: 137201 - DNA, 1046 bp, Homo sapiens
tgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgt

SEQ ID NO: 137202 - DNA, 1134 bp, Homo sapiens
agttttcagaaccatttaaggatctgttttcaaagggcgaggtatctcgggtgtttgggcagtctgtgtccagggtgtgccagctcagttgtttgggggtctgtcccaggatactaagtctctgagcggtttggaagtcaatgatcagggtgtggagcctccaaatagtttgggtagtgacatctcaagttgtaaggtctttgagatggttgtgcatctctgtcatcaaaggaaaggtctctgatgtgtttaaggtctgaatcccagtatatgaggcagtatgtgaggtctaagagctgtttaagggtctgtagcccatagttttcagtgaagcctgtgttacttgcggtgtgtccaattatgagagctctgagatatatgtaggtgtgtatcccagggtatgaggtttctgagaagtttggggtcaatattcagggtatatggtctataaggccttataccctagatgccctgtgtatgtcctggttaccctgtgtatgaggtctctgggctttttgggatcctgccacctctgtatgaggtctttgaaatatttgggtatctgtcacggcacgtgaggtccctgagcaaaaacaaagagcactggctccctttcagattgagagatgatgaaaatgagtaagtatatctgaaatgtggtcttcattctccactttataccctggcaccatataggtgctcaataaatatttgcagaaaaagtttccccagcacacacaaacttttcattttgaatgctggaggcagattttgggttcaaagcctttaagagcagggaaggtccagctagaatattatcacattttaacctttccattgatgtattcctctggttatttttgtttgcttatggcaagtgattatggtttttccatttagacagcagtggatttggttttctccctccccactttgctccactccttctaccctcccccccacccccccagtgctgtatagtccctgaggcctgggcacttggtcaggcaggaggtggcagggtctcagccagacattaccagtcatggctggtcaccaccaatcatggccagtcaagactggtcaaagctggttatggctagtctaagttggtcaaagctgatcacggccagt

SEQ ID NO: 137203 - DNA, 1438 bp, Homo sapiens
tatttctagcctgcaaggtctattacttatttgtgggtgtaagtccaagggtatgaattctctgatctctttgagggtcagcgtaccagaatgtcaagtctagtttggttatgggtgtatgtcaagatgtgagctctctgatctccttgtggttgtatgtctcaggatgtgagggttctgatctgttcctgtatgtttgtcaacagtgtgtaatctctgatctgtttgtggctctgtgtcccaggttgtgaggttctgacctgtctttctttctttgtcccagcatgcgagatctctgaggtgtttgggtttatgtcccaggaattgagtctctggtctctttgtgagtgtgtgcctcaagtaatatgtgaggtccctgatgtagtctttggtttatttcccaaggtgtgagtgctctgatctattcatgggtatatgtcctggcatgtgaagtgtctggtatttttatgtgtatatgtctcagggactgagttctgtgatctgtttgtgggtataaggccccagatgttagttctctgaaatatttgtgggtgtatatctcagcttgtgtggtttttgatctttctgtgagtatgtcacaggatgtgaggtccccgttctttttgggtgtgtgtttcctagaatttggattttctgagctgtgtgtgtgtgtgtgtgtgtgtgtgtgcgcgcgcgcgcgcacatgtcacagggttgaggtccctggtctgtttgttggtgtatgtccaggatgtgagttctctgatctctttgggtgtgtacgtcccacaatttgaggcctctgaattagttgatactctgcatccagcatattaattctctgaaatatattttggggtctataccctaagtctcagaaggattctgaatcctgaatgcgagggttctgcgctttttctggtctacattccaggggggtgagttcactgggctgttttgcggactgtgtttaccttgtgaggtctctgagctgtttgtccactggtgtcctaggatacgtggtccctgagctcttttggtttcaaagtcccttgacctgtttgggatatattttcaggcgtgaagtctctgttccttttcagagggctcagtcccggggtttgatatatctgactcattaggggtttgttccagggttaaggtctctgagcttgtaatgggtgtgtgtgcgccagtgagtgagttttctgagttgtttgaaggtctataggtgtgaaatttcttaactctctggtggttcctgtgcagagtatgatgtctctgaactatttagcagtctctcttttcaggtgtgaggtgtttgtacccttgtatgagaactctgatgtatttgagtatcaccgccaaactgttttgagccaatgtcccaacaaatgagttatctgtgatgccgtgggttttgtcctagggttgattt

SEQ ID NO: 137204 - DNA, 2157 bp, Homo sapiens
gacccctgtggatactaaaatccgtgaacactcaagtcccttatataaaatggtatggtatttgcatgtaacctatgtaaattcttctgtatactttagataatctcaagatttcttataatacctgatacaatgctacgtaagtagttgttatactacattgtttttatttgtattatttttactatgtttttaaattatttttttcctcagtgtttttgatccagacttggttgaatccgagggctgatagtagatataacatatatatatattgtgtgtgtgtgtgtgtgtataatatatatacctgatttgttgaggtgtgtatgtgtccaagctgtgaagttattgagctatttgtgggttatttcccttggtttgaaaacctctgacctatttgggagtatgtctcagaatataagctctctgatctctttatgggtgtatgttgcaagatttcaggtctgtgatctatttctggctcttttccctagcatgtgaggtctatggcttgattatgggtctgtattgcaggattgagacctctgatttgtttatgggtatctagctcaggttgtgaggtctctgatctgtttgtggctttatgtctcaagatgtcaggtctgtatacctattctgcatatatatcctgcaggtaaggtctctaggctgtttgtagtttcatgttgcaggattcaaggtctctgatctctttttggttgtgtttcttacatgaggtctgtgatctgtttgctagtgaatgtcacagtatgtgagtgtctcttttgtgtgtatttgtcaaggatgtgaggtctaattcaacatgtcccggattgtaagatacctaacctggtagtgggtttatgtctgagaatgtttctttctgcagtgtgtgtgtgtgtgtgtgtgtgtgtgtgtgtgtgtgtgtgtgtgtgtatgtcccaggtttggagatttgatctgttgggggtgcattttgcagcatgtggggcccctgatatcttcgtgggtatatatcctatcatgtcaggtccatgttttctttgagtgtgtatgtcccagatggtgagttctcttatgtgtttgtgagtttaattccaagtgattgaagactctgagtattttttggtatatgtcccagaatgtgtctctgctctttttggatgtctgttagagagtggaggtgtcttatctatttggaagtgtatgactcaggatgtaaagtctgtgaattgtttgtgtgtgtatgtaggtctctggtagctaatggtaccccaaagatgtgcacttcctaatccctgaaacctacaattatgctaatttacatggaaagggggactttgcagaggtgattgtgagggactttgcagaggtgactttgtggaagttaagcatcctgagatggggatgcttatcctagattaactgggcaggcccaatgtaatcacaggtgtccttatatgagggaggcgtgaaggcaagagtcagagagggctatgtagtgatggaagtacagaaaagatgatggacaacatatacagagatcaaagagagctagagatagatggatacaaggagagacagatgggggaggaggaagaaaggggggtggggagagagacagagagagagagaaagatttgaaggtgaaacagacctctggctttgaagatggaggaagaggccatgagctcagaaatgtaggcagcctacagagactggattctttggccaggcgtggtggcccacgcctgtaatcccagtactttaggaggccaaggtgggtggatcacgaggtcaggagatcaagaccatcctggccgacatggtgaaaacctgtctctactaaaaatacaaaaattagctgggtgtggtggcgcgtgcctgtaatcccagctactcgggaggctgaggcagtagaatcgcttgaatcagggagtcggaggttgcagtgagccaagatcgcgccactgcactccagcctggcgacagagcaagactctgtctcaaaaaaaagaaagaaagaagaaaaagaaaaaagaaattggattctccccaaggaactccagaaagaagtcagctctgccaacaccttgacttttaccctgtaagactctttgtcagaaatgtaagatcataagtttttttttattttta

SEQ ID NO: 137205 - DNA, 2019 bp, Homo sapiens
ttaagtaatcatcttgagatgcggggacggttctggatttcccaggtgagcccagtgtaatcacaagggtccttagaggagagaggctggacagtccgagtcagagaagcagatgtgatgccagaagcagatatcagagagatagagatttgaagatgaaatgctcctagctttgaaggtggaggaaggggccacaagccaaggaacgcaagcagctctagaaactggaaaaggcaagggcacagattctcccctagagcctccaggagtaatgcagctctgctgacactgtgattttagccctttgaaacccatttttttcttctgacctgcagaaaagtaagataataaatgtgtgttgttttatgacattatgattacgatttgttacacattgatctctgtttattggtacacatcccaggatgtgaactccatgatctgtttgtgagtgtatgtctgatggtggaagtctctgatctgtgtgcagttgtatgaaccacattgagaggtctctgaatgttgagggtgtgtgtcccagaatccgtggtctctgagctgtttgtgtgtgcatgtactaggatgtgacatctttgagctgatttttgggagtacattccagtaggtgaagtctttgagatatttaaggattatgttccaggttgttacgtctgtcatctgtttggggggtatttcctgtgacatgaggtttctgatttgtttggttacatatgtaccaggatgttaggttgttaggtgtctggtctgtttaggtttatttgtctagggtgtgaggtttctgagctctttgtggatgtatgtctcaggattgaggccactgatctgcttactggtaaagaaatgtcccagtccatgagctctctgatctgctcgtggttctgtgttatgagatgtcgggtctatttctggtgttttcctaacctgtgaggtctctgacttcattggagttgtacattgaaggatttgagatctctgtttgtgggtgtgtgtctcaggagtgtatggtctgtgcattgcttgtggagtatatcccaggatgtgaactttctgatcagtttgttatatatgactcagggcctgaggtttctgatctgtttgtggattgtgttgcagagtttgatgtctgtggtctctttgtgggttcatgtacaggttgtaaggcctctactctgtttgtgggtgcatatcccaggatttcagctccctgacctgtttgatgctgaatggcacataatctgagggctctgcgctatttttggtatttggggtctctgatctgtttgtggttacgtgtccatgttgtgaggtctgttatctatttgtcagtatatgtgccaggatgtgaactccctgatatacacgtaggggtgtatctgatgtgaattctgtgatctgtttgcaggagaatgaaccagggtggaaggtctttaacctctttgagggtatgtgtcccagaatatgaattctctggtctatttctggattcatgtcccaggatgagtgatctctgatctagttgagtatgtgtgtccagggaagaaagtttgtgaaccctttgtggtttcaggtcccgtggcctgaagcctctgatgttcgtggatacatgtccaggttgttatgtctctgatctgttggtatatgtctcaggatgttaattccctgatctgtttgtgggtggtgtctgatggtgtgaaatgtctgatgtgttcactggtgaatgaaccactgtgtgaagtctttgacctttgttgagggttttaacataggatctgaattttctgatctatttgtaaaagcatgccctatgagatgtttgatctttgagctctttatggatgtacatcccaggatgtgagttctctgagctgttggggcatacatgttctaatgttctaggttatcagacctctgaagtttttttttagttatatttccaagcatatgtgatttatatgctgacatatatattcatatatatatgtaacaatatagctgtcc

SEQ ID NO: 137206 - DNA, 1051 bp, Homo sapiens
tggtgtgctctgtaaatgggaattatcatcatcattattattattagaagcagcggtcgcaacatagggaaatctgtcctcacagggaatggcaggctcgaggcatgtctaagagctaagacaagggtttggccgctggactcaccccatttcttcatttctggagagcacagagcgctcaggaagagaagccaagggtgaggagtagggcgccccagagccctgcctccagcaagagctggaaaccccgaggctgtgaggccaggcctcaccccattccctcccccatccccgtggagggggcgcaggctcagaagtctgcggcgacagttcagccagcaaggaggcagctgggagtgggcagataagggaatcagtggggccagatcaggctttgggggagacgagggcgggggtggggtgtcctggccgcgcgtcttctccgtcaggcctaagtttgagactcttcttcaatgtcctctcttctcggaagccttccctgactggctcactccctcctggcatcttctggggttctagagcccctgcttggtccaggccccatggcatttgtactgtttgtgcctcttctgtactgtggagcccatcagggtggggacagagcctgacagactgtggtgtcaaaagcaccaaggcaaatgtcaaccaaagcctggttaaggagtcaagcgtttgccctcagaaacaaactgttggttgactgttttaaaaaatggaaagtataaagggtgctgtaacaagcatctacttttgtcaaacattaatattttgccttattgacttcagattgtttttaaaggatatgcgatattacagatgctcttgtactgattccatttccctctctccttctactgccttgagcttggtgtttatcttcctcatgagtatttttactccatcactccatatgttggtacccataaacaccatatgatacctggggtttttttggcctgtttttgcacttcatggaaatggaagcacatcatacagtatgtgctgcttttgctcagcataatgtctgtga

SEQ ID NO: 137207 - DNA, 1076 bp, Homo sapiens
ggtaacgttccaatcccagccctcaagggagggtctcaccgggctgaagggagcagatataaggtctagggggcagatatggggcttagggggagatagaggtggaatttgaaggtcagatatggggttaagtcagagaggtttggggtgtagccatggagtttgtggggaggcagatatgggcggggttgtggagcagagacgagcttggaagttcagagacacattttgggctcaggaataggttgtgaaaacagacgaggttgggggatcggggcgaagtttgagagtcagaaataaagttgagaagtagtgtgggagtcagattctgagggtcatagaaaagtctggggagttcaagggtttttctggaggagagatggagtttaggagtcaaagatctgtttgggcagacagaatgtggctagtaaaggggagtttgagaagccaagatagaattggagtagagaaaggcttggagctggagagattcagggagacaatgagatgtgttttagggctgagatacggtttggggaaggcagacatgagggttcatgcggcagaacagattttggggagttgacttggtgtttgaagtgacaaagatattttactgagcaggcagggagttgggagagataaatggtttgcggagatcagagagaagtcattgggaacaaagagtgggtttgaaaggcagagatggtggtaagaggatggagctagggtttggcagatcagagacaggtttgggggctcagagagagtggggcaaagacaaggcgttgtagagcagataaggggtttgggagcagaaaagtgaggtttggaggagaagtcagggagacagagacaagtttgggtgagtggaaatcagatatgggacagggaaaggatttggggagataaagtcatgttttgggagacagagttagtgtttaggggagacagacctaggggtatagcgagcaaagtgaagggatccagaggatatagatatcttggacggagtggatgagagggcagaaagaggtggggtttagggggtagatttggggtagaaatgggagttg

SEQ ID NO: 137208 - DNA, 2384 bp, Homo sapiens
gggtgggacacacagttgaggcagggtagagccccgtcttgccgtaggcccagccggcatatggtgagccccctgggatcccctccatacagttgagcaatgggtacacctgaaagactgttgggggcaggtagggatggaggaaagaagaggcaaaatcagtctagggtcagcgcacgtcagggtgcagtggttcccagcacccccaacatggtggccaagttcccagcttttccacaggctaccagaacagctgctggccattggatgcttcctggatcctgacccccactggtcagtgtggcctctgcaataacctctgaccatttccaagtgggtttttgaggatgactgttgggatttggagctccacggatcactcgacaactagggcaaccaccacatacttccagtattgcctctcagtgtggccgccccaatatggcaggttgaggagcattggaattcccaggtctgcacttaactagggaaagtggtcggcacatccatttgagaagcttccagccatttctgagatatcctcacagtggtattctgacctagccaaggatctccatggcaaccccaacagcactcagccaatgccaagacagccactcaatggagttacctggggagtgtctgtaggcctcagcgtccctgtagtaggccagtgccgcagctgcagcggtggctgtgctcggggcagtggaggaagctgctgcatccaagccctcaggcccagaggggaagaaaacccctgattctggtgtggaggacaccagagcaggatccacaaactgggggaggggctctgaggtccccagggaccccaggccagggaactccatggagcctctggggattaacctgcgaggacagaaggggtcctcagacacagaaatccttccaccccacatcctttcacctgctcctcttcctcctttccccctcctcccactccatcacctcagtctccatatttctccttcccacctccccattcccccctcctcctcaccttagtctcccctctccttcccctccttctcttcctccctctcctctcttttccctcctgcatctccccgttccactcctgtgtgcccctcctttcatcttcctcctcgttctccccctcttgccgtttgtctttcctctcctccctcctctcgctcttcctccactctcatctgcttctacctctcccttcttccttccattctctctcttcttccccccttcccttttcctcctgtctttctcccgtctctcttcttcccatctcttctttgcccccctcttccccatttccttctctttccactcttttctcattctctcctgcttcctttttctcctccaccttcttcttttcctccttgacctcctccttctcctttcctgtttcccctcttccttgtcctccttctctttttgtcttcattctccttttctacctttctcacacaccttatctccctctcccccatccacacacacttttttttgaggcagggtctcctctgttgccaggctggagtgcagtggcacgatctcggctcactgcaaccactgcctcccggcagtgatcctcctgcctcagcctcctgagtagctgggactacaggtgtgtgccaccaggcctggctagtttttgttttttttttgtagaaatggggtatgactctgttgcccaggctggtcttgaactcctggcctcaagtgatcctcccacctcagcctcccaaagtactgggattacaggtgtgagccaccacttccggcctctcttcccctgtctacatctactctccactcctttctcctactactcattttctcctcccctccaatttcttcatccttctcctcccttttctgttcatccttttctccctttccccatctcctctcctcccctcctccacttcctcttattctccccgtccccccgtcctttcttccctccccctctagaagagtctgggtgagggtgggatggcatgcaggaccagagtcccttgcctcttggtcacttcacccaggactttggggttcaccatcctctgctccccaacttcatccctatctgttgtatcttgccctctaactttctcagaaaccccatggtttccgggcttgactccctcctccctccacctctgttgcgtctacagacagaaggcccccttagttcctccctacttcttggttgggggggggtcagtaccccccactgcttatctctgccttccccgcccaacttttgaaatcaccccaaggccactgacttcctctgaagagggtggcaggtgggaggtacctctaccggtaccctctcccctggagaggcccaccagagttctgctttcaggctcttt

SEQ ID NO: 137209 - DNA, 1046 bp, Homo sapiens
acacacccacaatttcaggactttggtggttttattttacaaaagctttgaaggttcaagccagggggtgcctggggcccagagacttgggttgtccagaattctggctacaagaggagaaggacaccacccctcctctggaggccatgctctgtgccctcatgagctgagcggagccaccacagtagtgctggtggtggggggcatggggcctgtggggaaggagcccgtgggtgagcccagtaggggtccagggaaaggcatgaggtggctaacaggccctgacagcaccacagggcccaggccttggtagagatgggcagtacctggggggcccagtgtcaggcctgaagccacctccccacaattcccgctaccgctgcccccagccaccaccataaagccaccagctggtccttcggctgctcctgtgcctcccagactggagccccgtttctttttcccttttccagatgccttgcggtttcgagtctgaataccatccttccgcatggtcagtggccggttcacctgccaaaaaggaggctgcgggtgtccccaactccagacctttgcctctctgtgtcaaccagggacaccctctctaccccacttctttcagggtaagataatttttgggtgctgagattgtccaaggaatcctgaggctgtgaggccctgagcttaggaaagcctccaaggctgataggagctgcccaaggtctagggcagggggttggacattagctgatgcctggaggtgggggagaggagaggaaggaggagggcggaggaggagggaatggagaaggaaggagggagggtaataacagagaagggggaaagtagaagagatggaggaagggggaaagtagaagagatgggggaagggggaggaaggagggaaaggggaaagaggaaagagggttgtgggggaagagagaggtagaacaggaacagagtggggggcagtgtggcatgaagacagggaaagcagaggggtggctccaaggggcagggcgtcacctggtgtagcttgtagtaga

SEQ ID NO: 137210 - DNA, 1224 bp, Homo sapiens
aaagagaatcgtgtaaaaggggtggagtctagcgggccgggcggggccgggtagaatggccacctgagtggagggagaaggcctgagagaggcggagtttggaaggctgtggagaatcagatcgcgtaaggaatggaatctaatagagggggcggagcctggaaaagggcagagaggtggggtcctcagggcacactagccccctcacatacccacgctcctccccccacccccagaaccgcggcaggggccaagcctcctcaactatgacctcaaccggccaggattccaccacaaccaggcagcgaagaagtaggcagaacccccagtcgccccctcaggactccagtgtcacttcggtgaggccctagacccgccctgatgagggggagagggagcaagttggtcatgccctggactctgacccttctctctgattcacagaagcgaaatattaaaaagggagccgttccccgctctatccccaatctagcggaggtaaagaagaaaggcaaaatgaagaagctcggccaagcaatggaagaagacctaatcgtgggactgcaagggatggtgagcagggcctggctgcagtttagcctcgtatgacaatcaaaacccaaaggttccccaccctggacagttccctctgactcagggcctaaaatggatctgtgtctccttttttttttcctctgcaggatctgaaccttgaggctgaagcactggctggcactggcttggtgttggatgagcagttaaatgaattccattgcctctgggatgacaggtgaggctgggtcctccaggctgtctccaaaccacaaaaatacacacacttagagcccattagcaagaataaatcttttcttaccccagcctggatactggaagcagatgatttggggaggtagggctcacacttgaaagggttcttttatgtagctaacaaacatttattgagtgcctattgtgtgccaagagttggtgatacaaatgtaccaaacaacagacaggggtccttctctaggagcggattgatgagtaggagggcagatcattaaacagccaacagcagtatgaggtgtttaatgaagacagacttaagaccaggggattcaagggtgtataatagaggatcctaaactagtatccgggcttcccagaagcctttatagaggaagagacgtttgtactgaaacagaaggatgaaacctcccgttt

SEQ ID NO: 137211 - DNA, 1048 bp, Homo sapiens
cagggtggctacaacctccgcgccctggctgaaggcgtcagtgcttcgctccacacccttctgggagacccttgccccatgctggagtcacctggtgccccctgccggaggtgagccccggtggaggaggggaaagcgggagcctcactgcccgcccacattccttgacatcatattttctccctgccctgcagtgcccaggcttcagtttcctgtgctctggaagcccttgagcccttctgggaggttcttgtgagatcaagtaggaagtggggtgtgggcctggtgtggggtggacgtgggatgagccctgggggagactgtcttcagacttcctctgactttactgggctgccttggtgggagagggtcaggccctctctctctccctgggccctggtttcaggcctcccacccctttttctgtttgggtcacctgagttccagagtatgacggggattcagattgagagggtaggacaaacgtggcctcccccttttagctgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacaggtaggcatttggagggctggatgagtaggtgttgggggtccctccccctcaggcactaagcctctacctctcgtttccccactgctagccaccaccctgaggtaccccagcgcatcttgcggatcatgtgccgtctggaggagctgggccttgccgggcgctgcctcaccctgacaccgcgccctgccacagaggctgagctgctcacctgtcacaggtcagaccccggtgcctggggtgggtggattcccaggactgtggatgaggtctcaggggctggaacttgggtttcccctcctggggagctgctgcaggacttgagaggggctgaagtccctgtcttaggggtggggaccagggaggggacagaccctcc

SEQ ID NO: 137212 - DNA, 1868 bp, Homo sapiens
ggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcaggtaaggctcaccacacccaggtaggggcaagaaggggcaagaatcgggcttctctgatacatctcttacttctgcgtgtccagggggcctcagaatctcaggccccaggagaggagaacctactaggagaggcagctggaggtcaggacatggctgattcgatgctgatgcagggatctaggggcctcactgatcaggtgagctcagggagaggctgggactgtggcttccttctcttgccaatttgtgtctccaggtaggagcatgtgatgaataaacatataatggggagatggggtcttcagcttacctagtttcacccacccactccaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtatggagcagaggaaggggatggggcggaggttggcccgggagcaaactgcagggggatgctgacccccacctgacactcacacccccaacctcaggtctactgtggtcgttacatcaatggccacatgctccaacaccatggaaattctggacacccgctggtcctcagctacatcgacctgtcagcctggtgttactactgtcaggcctatgtccaccaccaggtgggccctgggtagacccttcgacacgtgcacactcaccccccacacacacaccccttctgtgattgggtaaagggagaccacaggcccctctgcatggctgcctcatgtgattattttgcatggggcgggggctgtgggatagtccagaagacagagtggttgagggctggagtgggggcagccctgcagccgaggtagaggggtcctcactctctctcacctgccctattcttgcctcctcctcaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaacctggagaaagctttttgactttgagcaggtggagaaccccacatccctggccagcagagccgatgagtaatgaaggaatgagggagtgggtctctgtcaggtcaatcccctgcccatccatt

SEQ ID NO: 137213 - DNA, 1392 bp, Homo sapiens
cctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattctttcattcaagaaattcagggggagcccactgtgtgctaggctccgctttatatataagggaggtagaggcaaacaagacacttaaaaatccttgcccttatagatatggcatcaggctagatagtgataaaggctacgtgttaaaggcaggtgaaggaatagggtgacaggtccaggaaagccttcttgagagtaggtgacatctggacaaaaacctgaagatatccagaggcagagggactagccagtgcaaagaccatggccacaaatcagctgccaccacagcaaccctcagtatatccagggcctggagcaagagtacaggtaggcctctacactacataactaaatatgtaaacgttcagacattacgaatcaagctttacaaagtaaa

SEQ ID NO: 137214 - DNA, 1042 bp, Homo sapiens
ttttggtggcatctgggatgtttgaggcctacgaagcttcccgggctgggggtccctgtctcgacggacgctgacaaactcttttcccccacctcattttcccgcaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtgcccggcagggggtggggaggggtcgggcgcctgcgtccggagaggacgagggcgaggaactgggaagcctgcttaccccgtggagtgcgaacccctaagtcctggggcctaagagggagtgaggtcctggatccagggagtccaggcaaggatgcctggctgactcagtgggggaagtggaccccaggtcctgggaaggggagagggaggcggggaagccacagttttctgggatgaaaggcgatgacggctgtctactgaaagcagtgggctgaggacgccttcttggggagggaaccgtgtccccaggcagtatgtggttgtggatcctgcgttctgggccccgagcgtggggcgggggaacgccccaccgcggacaccgcctcactgctttgcgctcggccctgcaggtacttgctgggacggattcttgcgggaagcgcggactccgagggggtg

SEQ ID NO: 137215 - DNA, 1084 bp, Homo sapiens
ttggggctgcgccgcctcacccccgcccgagccggctcccgggacgtgcggagagatcgacgagggtggcccgggctccggccgccggtccgcgcccaggccacgccggcacacctgagacctgacttggtctctgcctgtgcgggtggcgttgtccggggcgccgccggtaaccgtgccctgcccacctctccgtgcccggtgcctgtgacgctgtccacggcactaaggcgctttaagaaagggcgcgcgcgcatcagtgtgtgtgcgtgtgatgtgaggagagcggtgtggaggtgtcgtgtccttgaaagtgtgtgttctttggtttgagcgcttccaagtgtcctagaaaggtgccgtggtgcgtctgggtgtgtagtgtgtgtgataccgggatacttctgtgcgcgattcttttgtgcgtccgattgttttctcagtgacaccgtgtggatatttgtgaatccttattatgtgtgttggcttggcctatgggcgtgtctctctctctctctctctgtctctctctctctctgtgtgtgtgtgtgtgtgtgtgtgtgtgtgtgatttcgtttgtgtttgagagggaatggtcttcgcatctccgtgtgcacattccatagtggttctgttggaccaagtgcctgggatttcgtttgcgtgttcctgagactgtttctctccgtttctttgtggagctgtgtcatcctgaggagaggagccatgatgtctctctgctgcattgtgtctttaaggatggtgcatgtccttgcacctgggtggcttggcgattgtaactgcaggagcagctgcggatgtgaacgtgtgcaggtccttgcatgtggctgtggcagtgttgggctgtatatgtgacatctccaggcctgtcagtcctcatgagtgtgtgtgaggctgtgattgctggtgagtgtgataccccggggtgactgaggagtggtgggcgccagcaagggcacttggagaggcatcctcctctagctcttcaatactgtctgcatcaaagatgggaattaaaaaaaactgttaccttatatccgtgtaacaatgtgtttaatatata

SEQ ID NO: 137216 - DNA, 2246 bp, Homo sapiens
tttttttttgtagagacaggggtctcactatgttgaccaggctagtctcacagacgggttttcaccatcttggccaggctggtcttgaactcctgacctcgtgatccacccactttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagac

SEQ ID NO: 137217 - DNA, 1497 bp, Homo sapiens
ccactcgcaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctg

SEQ ID NO: 137218 - DNA, 1089 bp, Homo sapiens
tgagttagggtggggcgagtccttctttatgtgactagagagggtccattttgaggatgggggtgtctttcattatgtgcggaggagaccgttctgggggctccctcctaatggaggtagagttcattgtacattcgggtgggagggctcatcgttatatggtggagaaagaacgttctgagagtgccgggtccttccttatagcagagagagctcattgtgagtgtgggtagagcaaggaaaaattcattagctagagggtccgtgtgcggtggtgggagggcagaccatgtggagtgcagggaagtatttcctcatctggttgagggagccagacctttcttggtgggataaccattcctgatacaggattcagtccctgggagcatgtgggaatcatttcttgtatttagtagactattctggttcgagaggaaccagttgtcacaggagtgaggggttggagagaccattctgggtatgaggaggatcattccatatgggatgtaggccattctcagtgtgagggaatcgaatcatttcttagataggagaaagaccgttcttagggggtgaacatacctcatacagtggcctcattccctgcattgatgtgttattctttacatgagacagtccctcattaaacaggagcatcatttcatataaattctcagtttgctaatccataaatgggaatcctcgcagttcttttggagatgacagtgatatgagtctattgaggtaatccatagaaatcccttaacccagtgataggcatacagtaaacactcaataaacgtggagaatgtagttgtcggtattctttctggggaagagttgcttctcacttgggaggaagccgaggcgcgtggccagggtttgcctcagccattacctgacacctcagtaaggattccaggtatggactgggacagggtggggcccatttctcccttctggctcttcctgctcatggctgaggcagtaagccggtaggagtcagacccttattgggtgagggcaggcaggctgagggagcaagtagccatggctaggagggtcctgggtgagaaagaaagggggtgg

SEQ ID NO: 137219 - DNA, 1155 bp, Homo sapiens
atggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttcttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatcagaagcggctggccatttgtaggtgtgaggcttttatggagcatctactgtgcactgagacagactgtccctctgctttgtcctcaggaagccacagtcttatgttgccatcctaaagagctttaaggattcttgaagctgcaccacacacacacaaaaaaatcttgattcccctgcccctgatcttatgcagtgcccagtatgtgcagaagggttctctgttggagatactgtgcatattgaaggtgtttagggca

SEQ ID NO: 137220 - DNA, 1076 bp, Homo sapiens
tgggagagataaacttggttccgaggacctggagggcaggggagacgccctggtacgcgttctgtggggtgctgtggttggggaccagaaagactagagtgctggtagatggaggaatactggaggtaggcagaaggtctagactgggaggggtctggggatcacctgctggcctccttatcacggccttcttctccaggtggccatcaaagtgattccccggaatcgtgtgctgggctggtcccccttggtgagtaccttcggagcccttcctaacctacctactccatcactgatgtattcacctccttgcttttccaggggatgtatgactccctgggccctgtaacagtgagaatactgccagtccatttatactcccttggggtgacatacagttctgattcaccccaattcccctagagccctggattctcccctccaacaaacctttaccatccttcctccaaacactgctgggggactgcccgcagggcgtgctggtggggaacaaggggcagaggtcactggttgccatggtgatggtggctgcttctctcttgccgttataacgctaacggacatcagggcgggtctgggcaagttgtagagttgggagcgccccctggcgggctctaggggaaactgcgcctgcgcagtccatgggacccaaagggagagggtgcgcctgcgcaatatcggtatttttgcatctcggtgagaaaacgtctgctgccgtgcaagtcagcagcctggccaggagagggctctacctcatcccagaaggttgctgctcgaagtgtacctgcgcagggcttggggaggcagtggggggcggattttgtggcccccagcgtttatacttttttttttttggagacacagtctccctctgttgcccaggctggagtgaggtgacgcgatctcggctcactgcaacctccgtctcctgggttcaagtgattctcctgcctcagcctcccaagtagctgggactacaggagcgcacaaccatgcccggctaatttttgtatttttagtagagacagggtttcaccatgttggccaggcgggtt

SEQ ID NO: 137221 - DNA, 3329 bp, Homo sapiens
tggagtgttgctctttgggagtacctgctttcctgtctccttttttttctggggcctgtgggcctacctcgctgagcctgttctggctcttgggcaggttcagtgtgttattgcacatccctgttcctctccctccttgcagtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccaggtgggtcatggactctgtcacaggcttggccaaaaactcattacttctcatgctttgccctcaagcgagcagaaaaaaattaagcagttttgacatctgggagggaaggaagcatccagcaccatctgtaactcatcttggtcttagttttggcattgtaccttggaactttaaatacttgtgcagaacaggcacttaaggagtgagaggagggcagccatgctgctggtgacacgagaataatggatagcttcagagacacaagcttttgttgactgcccttgtgtgccaggtctctactgagaatgtaacatcagatctggactactctgccctcaacgatctcgtctgttggcagagacaactcaatggtggggtccttgaccctgactgggagatcagtggaggtgggggctccggttagtcttcacagaggaaggttgaattgttaggggagcggggaggggcggggcagacaagcatctgaggaattgtaaaatcgcaaggagtttggagtgattgtagatgttggctggcaggagctgagttttttttttttttttttttggagacagagtcttgctctgtcgcccaggctggagtgcagtggcgcagtctcggctcactgcaagctccgcctcccaggttgatgccattctcctgcctcagcctgcggagtaactaggactacaggcgcccaccaccacgcctggctaattttttgtatttttagtagagacggggtttcaccgtgttagccaggatggtctccatctcctgacctcgtgatccgaccacctcggcctcccaaagtgctgggattacaggcgtgagccaccgcacccggctgaaggagctgagttttattccacaaatacctactaccagtctgtggcaggccctgttttcagtatatggggatacataggtgagcccagcagaccaagatccccgtccttgtgatgttcacagttttgcagagtgaaataaaataataaatataatgaataaattagttgggaagtgctatggatggaaagtgtagagccaggataaaggggctgagcaggaatgtgcgttcacggtatgaaatagcgcagtcagggtaggcctcagagcaggtgagatttgagccttgcagaaggtgagagttagctgagcgcacatggaggggaggacagcaggcccacacacctggtacaactcaggcacagcccagagggaggccggtgtatccgaacagaatgtagtagtagatgaagtcagagaggttgtgggtccaattgggtaggggcttgtgggctgtggcgaggactttggcatttactctcagagaggcagaaaccatgggaggattgtgagcagaggacggacaggatgtggttggggatttaataagatcgccttgcctgctagtcatccagtggagtctggtgagtgagggcagaagcaggggccagtgaggaggaggctactgcagtaggccaggtgactggtggccagtgctggcagtggagttggtgagaaggggttggatttgagatctattttcaagatagaggtaacagggtttcctgtcagattggctgtaggggtgtgagagaaagggtaaggagctccacctctgtcctgtgaggagtcttgtggtccaccgtgtgagtggggatgatgttgacctacatagaagctgtatcatagccaaggtcctgggaagggagccagcattcagggatgggtcacaagaaggtcatggctgctggtggtccttaacgcatttaccttccccgctgcagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtcagtgacttgcccacagggaatgtgctgggagttaggaggcacgtcctgggtcctgggtcctggatcctgggtccctacctttgactgtccgtctgcttcaggtacaagcagtcagttctcggcaggggccgaccgggcaacttccccccttgtgtccctctaccctgctttggagtgccgggccctcattcagcagatgtccccctctgcctttggtaagcctcctttgtctggggggatggaggctgctaggagctgggagagactggaagaagtggcaagtcctgagaggggctttctggagcctctggccatctccccaagaaaagaagggagaggcactggaggggatttttcagatccaaggaatttgccccagaagggtctggggtctaagtggggtttcacaggcctagcagatccttctgttttgagaaaggagtgagaagggccctatgggatttctccagagccccagatgtcggcacagggtgaggagaaggcaggctgagagcgctccatcatccttttcctcttcctctcgcccagcaggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagaca

SEQ ID NO: 137222 - DNA, 1034 bp, Homo sapiens
cctccccccagcccgcacacttggtcacagaagtctcctgtgttgattgttgttgagtgagagtagaaaaaacacttggagtgtgtttaacactgccagagtggttagattttttgactatttttttaattggcttgttctaacatagttttacgaattgtttttaactattcacagtaaaaaattacattttatctgaatgcaaggtctgcaggaaaaagaaaagaatacattttacatgattacttagcatatatgcatttgtgtgtgatgtgtatatgtgcattaaaataatgttaactaaagcttcatgaaacaacatttgcacttattccctgggatatattctgatattttctattttttaaaaatgctgttggatctcagcctgaaaaacagtactctgatgtagtgtcctgtaactcatagcaccccacaccatgttgatactgcccccttattccctcacacacccactacttcccccaacccctcacatgcttgaatactccctccacccggtgcacacatagctaatttttgtatgtgtctcatctgctcatgtgtgtgaaagtcctcaacattatgaaacagtcatcactggatggggcttctttaaattaaggcccagggccaggtgcagtggctcacacctataatcccagcactttgggaggccgagtcgggtggatcacctgaggtcaggagttcaaggccagcctggccaacatggtgaaaccccatttctactaaaaatacaaaaaagttagccgggggtggtggcactcacctgtaatcccagctacttgggaggctgaggctggagaatcccttgaacctgggaggcggaggttgcagtgagccgagattaccccactgcactccagcctgggcgacagagcgatacttcgtctcagaaaaaaaaaaaaaataagtcccaggttggaaggcacctgactgctccagtctcagtgcctcagttgaggtggtttgggggttagagtcaggtcttacaagcataggagtttggaatg

SEQ ID NO: 137223 - DNA, 1034 bp, Homo sapiens
cccaagtagctgggaccacaggcacacaccaccatgcctggctaactttaaaaatatttttattttgtagagacaggatctcactgtgttgctcaggccaatctcaaattcctggggacaagtgatcctcccgccttggcctctcaaagtgctggtattgcaggggtgagccacctgcagccaatttgcttttttcccccctgaaattaaaatggtcaatgtgacagactgcttcttttcacttagcagtatgcattaaggtttctccatgttctttcatggcttgttagctggtttctttcttatcacttaatgttccttttatggaggtaccagtttaattattcacctattaaaagacattcttggttgcttccagtttttgatgattatgaataaagcttctgtaatgtgcatgcaggtttttttgtggacgtaattttttagatcagttgtatacatacctgggagcaagattgctggattgcgttgtaagattatgttttgatttatgaggaactgagaaactgtcttcccaagtggctgtattatttgcatgcccaccataatgatttggaagttcctgttgtcagcattaccagcaattgatactgtcattgtgttggattttagccattctcttaggtgtgtagtggtatctcattattttaacttgcagttgcctattggcaaatgctgttgagcatcttttcatatgcttatttgccatctgtatagcttctttggtgaattgtgtttgtgacttcctgacatacaattcctaaaatccttagaatctgcaaagtgttgcctttttgtatgctaatgaggtgactgatggctggcagcctctaggtagcttcaggatgggggctggtgacctgaaagaccaaggcaggattagaggtttgcaactttaagcccatcccccagcctttggggaggggagagaggctgaagattaggttgatcactagtgtccaatggcataatcaataatgcctgcataatgaagcttccaaagaatcccaaaa

SEQ ID NO: 137224 - DNA, 1805 bp, Homo sapiens
cttgtaggagtcaggaaaactgaattcagagttgactctgtcacagactgactctttgtgaccttggacaaaccacaaactccccctgaacctcagtttcctcatgtggaaagcaaagggggtgtgggaatcaatagcatttgaggccaacctgtggaacttagaatgttgttgatttctctgagtggccacgtgtaccctagacaaagtcatctgcccaagaggcctgtggatgtgttcctctcacctgcactctcttgttcttcaagtctggccctgcctgccatatttttccatgaccccgttctagcctacaagggcaagaactctccaggccttggggtagaaaagggaatttccctggtcccccagttcctcctccccaaaggatgttctatgattcagagctcttctctggcatctctgaccctagctgctgctttcttctgcccccacagctgaccaggtgtatggagaccaggacatgcatgaggttgtgcgaaagcattgcatggactatctggtgagaaaatggaggcctttggggaaggggcagggtgggaggatttcttctccacacagaccttaaccttccaatctattctgcagatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtgggtaggtgagggaaagatggtgcctcattcgagcctgcccaacctggcctgctgtggatgctccctccttctctttctctgcagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccaggggtgagtgggtccctgtgcccagaatggctgctggatatagaggtcagaaacctctgttggagtctgttttgcccctaactcacaaaaatatcctgtctcctctctcccctgaggtctcacccttacaaaaaaaaaaaaaaaaaatagggagttacttaaggtgatctctcagggcttgttctttggtcttggtttgcctgtctgagttggcttacctatcttttgtgcccgttgagggctggcattttaggatgtggagtcctattttggagcagtgagccagggcttgctctgggcatcttggcatggatctttctcctgggatcatagtggttacagacagccatggtcacagagacatggggtacaggcctggccccaccactcactggctgtgtgatctaggcagattctgtaagtattccaggctggcagcttggctgatacagaaagcacctcccactgggcctggggcctagtaggtgttcagaaggtggcagtgcattttcccagcacataccgatagattctcattcatttctctctctctctcttacagtcatttgctgaggattttggtatcttctattcaggtttcacttctacaaacacaaagtactcctgcttcattttcggaaacacatagcctaacaccaacacaccctccaacatagggttcttttttgttttgtttttaaataaacttaattttagagcaggtttagatttacagaattactgcaaagaggctgggcacggtggcccacacctgtaatcccagcattttgggaa

SEQ ID NO: 137225 - DNA, 1163 bp, Homo sapiens
ggagaggacatgcatcctaggtctgcatttggggctttcctctggctgaggaattgcaacagaaatgaggaagggcttcataagtggttatggcaacattctggctgactcgtgggtaactagcatatgaaggaatcattgtcgtcatgacaaattgtgttcctgtttcttgaccacctactgtgccttaggtgcttggcaaacctcctgtgtagttttgacaacacccagcagatggaagaggagttactgtctccaccttatgcatgaggacatttcagcttagagaggttaaaggccttatccattgctacacagctaggaggcagcagagcctttctgccaggcaaaggggtcagtggcagagaaatgggaccctcagggggttttcccccagatcccttccctgttccacagtctcctctctttccccattttcctgcatctggcatctagctcttgaagatagaactcccaggcctggaaatgaccgttgacctttccataggagatgggctttctccagcacctcagcctatctctctgagcctggccagccaacccctatttaaccccttcattctcatctttgttcctgtttactgcagctgccaacagcactgcctcccagtaccccaagctcagtctacagaaatagctccccaagtagctcactgtgcgggctctgtggtcctggcttctaagaaaggcagcagcagggggcccccagcctgtgcgcaggacatgtgacttgctggaaatgccgctggggagggcgggggagagtgtggccgcagaacccacatccttgtttacattggtgaaggggctaccccccttcccgccttcacaacctccacacccccttacccttcaggtctcttcacctccaagaggactggagacaaacatgggccctattttctatctcagagtagcctttctcacagaacactccagggtaggaaggggaaggcagggaaggtgttcttctgacagttcttcagagaggtagactgacagggaagaactcaggagtgttcctgtgtgacctgaccctagccccatgccccagggagatcccatcagagcagtggtcctctggggaaacaaagggaaattcccaaaaccagtggaaatcagacttgcatgatcttcaggcc

SEQ ID NO: 137226 - DNA, 1055 bp, Homo sapiens
caagggcatctactcattgaatgtgatagttctctgttgtgggatttgttgggtgagcatttggcctcagggagcatctttggcagtctctgctgtatgtgtatacacatgtgcatttctatactggtgtctctgtgtgtccagaaaaaggaaagaagtggggtgtgtatggggagggtaaggttcatattggcctctgtggccctagggagagatgcagcccctgatatctataatctctgccctctcccatgcctttcctgggttctagctgattcctgcttgtgctggtgtggaaactgaggcacacaagatcaggtcctgccccagggagtaaggtgactaagatggtggctggattggggtgaaggtggtaatatcagctggggccagcagttaccctttgagagcctggcctccccttcactccccctaaatctgtgatcccaggcaagctttgccacatttctgtgtctcctgggtaaagtaagagtgttttggtaaggatagaatgagttggagtgtgaaaagtctttggtgtgggaccaattgtagtattgtactgaggatttctgagccctgtttgagatgggaacagaggtagaatggtgggggacccccttccagctggcctctgggaggggagaacaggtgcagattgcccacaagtgcagcgtcagcaagaggaggagtttcagtttctatcaaaacaagttctctgaattcccctacctctgcaggtcatccccccaacctcagacccctccacagggaagtcaagcctggcccccagccctgtgtgccagccttctgggaagaggagggctttctggaggacagaggtggagctaggaaagtcagaaaaacgaattcttttttttttttttgagacagagtttcgctcttgttgcctaggctgtagtgcagtggtgtgatcttggctcattgcaacctccacctcccgggttcaagcgatttttctgcctcagcctcccaaatagctgggattacaggcatccaccaccccgcctggctaattttttgtatttttagta

SEQ ID NO: 137227 - DNA, 1504 bp, Homo sapiens
tgtgagccaccatgcccggcctacagcatatcttggaatcctctagccctttgtcaggttcaggatctaggctcttgctagttaccccctcttcaccacctttcctagatgaaactccttgaggtagagccacattctccacccaggcacttgctgggtctgagtctctggctgcctgaggcagtgtggctccctgggccaggccctgcaaggtcaacagaagccataaggcatatggggccactgttctcagggcacctaggacccttttggaagtaagtcttagtttcactcagcaactaattccctaaaagagtctcctacttcacatgcatggagtggtcaaacagggctgagaactttaccttggccagcgtcctctctgtcaatgatctaggcctctcgggagcttgaggtcggggccctggggagggagtacaggttttccctgttgctgacccccacctcttccctccagcaggagcattggtttgaaaaggccctacgagacaagaagggcttcatcatcaagcagatgaaggaggatggcgcctgtctcttccgggctgtaggtgagtctctgccttagtccttaagggcctagggctgcccctaagctgtgtcccagttatcaggaatagcccctgagacagggttgaggcagagctagctaatcttttagggactctaggctccagcctcaagttggtatctgacctctagccgtgggtcttgagacattgtagtggtgcaagattaatatgcataataacagcaagaagaatgataaagaaaataatatcctttgggacacattgtcaggtgctacaggaaacctctttgattcccctctaagctaggtgagtgtagggactactgttgcttccatttgtcagatgagaaaagtggctcagagatggtgggtgacttgtctggagtgaaataataagtggtagagttgggattcagtgtctgggttagattagtctgaggcccatgctcttaaccatagcacactgctgccaccctgggctgtatgacccctaggtttatacccagatcccatctctggtgtgttgcgggtctctgttcctcaatctgtgtgtatgggggctatcagactagatctttacaaatttcttatatcatagaattttttttcaacttatataaaagtagagagaatgatgaaccctcatgtacccatcatccagcttcaaaatagtcaatacgtggccagccttgtttcatcactatcccgcccactctttctcactcccctgaaagaagagtatttttaaagcaaaaccccgacattggatcatttcattcataaatatttctgtatgtttctctgacagatacagacttactctcttctttttaacataatcaaaatgccattactgcacctaacagaattaataatgccttaataccatctgttatccagtctgagttagatctttgaggccattttggctctgaatctgtgacccaacaa

SEQ ID NO: 137228 - DNA, 1021 bp, Homo sapiens
ttaggggatgggttccaccccttgcttgagctggggaaaaatggccttacggataggtgggcccctatgtctggtctctaataccccagatcctataaatccctgggcaggcctgtgtccacaaggagcaggcttgggatcctgtagtttgcagccttgttgctaggtcaggctggctgcttctggtagccagcagagggcgtgaggggcccaggaaaggtctgctgcttctggttggttttgttttgaaatgaaaattatgttttaagaggttatatggtcattatttttttaataaaaaaatatgcatttgtacaggttcatttaagttgaaccttcgtggtgccaggtgtgctttggaatttaggaaaaaaacaatttataaaacttacctggtgtgtatactttgtgttacataacacctccagcagggtctgaggcagcacctcataatcaaacacctgaatgttttctgcattgaaatatttgaatatttaccccaagtgggataaatagattcttgtcagttctggtcaggttatgatgccaaatgaattagataaagacttttgggccgggcacagtggctcatgtctgtaatcccagcactttgggaggccgaggcgggtggatcacgagatcaggagatcgagaccatcctggctaacatggtgaaaccccgtctctactaaaaatacaaaaaattagccaggcatggtggcaggcgcctgtagtcccagctagtcgggaggctgaggcaggagaatggcatgaacccgggaggcagagcttgcagtgagccgagatagtgccactgcactccggcctgggcaaaagagtgagactgcatctcaaaaaaaaaaaaaaaaaaaaagacttgattttcaaagctttttgggtttagtgtaactttataaaagggaaagtgcaataaaatcgctgataacaccaggacttagggatattttgctgtctagccttcccaattttgtgtacgtgtgtttgtatacatacatatgta

SEQ ID NO: 137229 - DNA, 1097 bp, Homo sapiens
ggggaagggaagggaactcattaagtggtctcttactgggcaaagccctgtaatatttgagtctgcccagcatccctattattgggaggcttggtatccccattcacagattggaaaactgtggctcagagcagttcatcatcacatggctaataattggtggagctagattggaacctaagtcagttgggttccacagcctgctccaacttcacttgggcccttagaccactaggttacagaatcttgcctcagctcctgggatcctctggtgttagggagctttactcagcctttttgtggaggctcaaagatatggagggattttcccataggctcagcgatgagtttgcaaggttcacaatctcctcaggccagggcattgttggagcttaaacttatctatggctgagctatcccctaccccccacccctactagcccttcctgagcaacattttctccccaaaaggagaaagagaagggccagagcccaaactcctcaggctgctgatgacaaagccagtgggtggctagcagtccagcctctagatccaagcctggatgccagtttgactgccccaggacccaaaccctgcagtgcgaggggcctattcaggtctctttcatgtttagagacaaaccaggatattctgtggatgggctgcaaggtatgtcctccatgctgtggctcgtgggggccttccctgttgcctctacactaggctttgctggtatccaaactccagctcctttctctttctgcctttgtttttttgttttttgttttgtttttgtttttgtttttgagacatagtcttgctctgttgcccaggctggctggggtgcaatggtgccatctcggctcactgcaacctccacctcccgagttcaagcgattctcctgtctcagcctcccaagtaactgggattacaggcacacgccaccacgccctgctaattttttgtattttcagtagagacaaggcttcgccatgtcggccaggctggtcttaaactcctaacctcagatgatccttccgccttggcctcccaaagtgctgggattacaggcgtgagccaccgtgtctggcctcc

SEQ ID NO: 137230 - DNA, 1068 bp, Homo sapiens
gggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcaggtaagagctgtggggtgaggggtgagcggccacggcagatgggacccccagactgtgaagggactcaaggaaggctgtttgagatcgccccaagggatctaggcgttttcactgggcctgacagtcttctctggcggtagggatgtgagacaccttctttcctcccctccaggattttggggctagaggcctacggtaaggtgtcagacttaaagatccgaggtctcttttaaggtctatagtcgtcattccagtccctgggacctcatcatatagggccaataggtgggaattctccaagagatacaggtaggatcgcgcccctcttgagtaggagtctcaggtctcccaagagacttaggtatgtgttcagtggcttaagagctcttttcctctgggatagaagtttgagattccccttccaggaaagtcaaataaggtggagacctcggag

SEQ ID NO: 137231 - DNA, 1043 bp, Homo sapiens
atgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgaggactgagagtatctcctggctctgtgggtttgggggctgggttgggcttgggggttgaaaacactctgatttcaatcccttttggctaggagaagggctggtatgggtcaaggtatgggagatggatggttggtgatgtattctggaagatggggatccaggaga

SEQ ID NO: 137232 - DNA, 1056 bp, Homo sapiens
tagatgggatggagtgggggactgaaaggtaggtgggcacttttcctgaccttggcctacctcccctcgctccagctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcaggtaaccgcactttccatccgagcacctcctactccccacaccccaagccagtctactttggggcttacccacctgaccttttatctcctctctctgcagaaggtgcgcttggcaaggatccgattggcaaagagtggtaccaccaatgccttcctgcagtacaagcagaatgggggccttgaggtgggtcggggcctggatagggttggggtgagccataacggggaggaaggtgctgcccttatcgctctgctccatctactccaggacagcggcagtggcgaggaacaggctctttgtgtcaggaaccgttctgcctttgaacagcaacatcaccacttgctgcactgtctagagaagacaacggtgaggcctaatgtgaggtgatatagcagaatagagggggtccctctgcggccatgccagctctctcccttggatgggaggctcactacaaattgtggaaatcacacagagcttcctggaagaggctacaggagagccaagccttgaagaatgggcaagggaagggaagagggaacaatgtccagaaaggagaaaacagcctgagcaaaggcttgagggtgggatcagctcccatgggatgccccgtgaccctgcctcccttctgcccatagtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcc

SEQ ID NO: 137233 - DNA, 1034 bp, Homo sapiens
accttctctcctatgcctggctgtggttgcttctcttcctcctgctgccgctgctgctactgccactgcccagtacacaccgccagcccctcggggtgtggtttccccagacctgcccccaacggtgggacccagccttctcccggcgtctcctgccagcttcctgcaaagcccaggagcccccctccctggagacacacccaactccctttcaacaccccacccccctcttaatcccattttggggttaacccccttcctcttatttagtcttcatagatcccctgggtgctctgggattgtgcccaacttcctaacatttgagtcccggcccttggaattccccaggcccctttttcctccctgtagaactcctgagagtgtcgaccaggctttgttggcccgtctagatacccacctcccccagataactctcagcctctcaaaaaataacccagccccctgtctacccctttagataaccccttcccctctccagccctactaggaggctctggcctctcctttcttccccagaactcctgtagagtatagacacccccccgggctattcttggcaactctaggcagtcccaagacacctttcagcctctttacaacctcctggatccacagccacccctcaagatgcaccagctccctttccagatccatgaggggggtctaaccctcttatgcttcccctagaagtcttgagggtgtggacaaccctcctcacctgtctcagcccctctagaacccccacttccaggcactctcagtctctttcaagcacctctggtcccatttctacccctctggatgccccagtctcctctccaccactgcaaaggaattccaggctcttctgccttccctgagactcttgagagtgcagagaattccccacgtgtttcttggcccctctagacgcccccagacacctctcaggcacaggctgactcctttagaatcatctcagtctctctaaaccctccctcagctccttcttggccccatccccacaccccttt

SEQ ID NO: 137234 - DNA, 1049 bp, Homo sapiens
acccacccagttacctgcctgcccacctgttgatctccatctgtcctctggacaattcattcgtccaccaatttgtctaccatagatcccccatgcccatgggtccacacacacatctttctgcccaaactgccacccaaggactttccccatctctgagagttagaaaggggtcagacccagctcctgcctttgagaagcaagctcacacttagaagagcaggtggccagagtggtggtgtatcctgcagcagcaccatgccacaggaggcatcccactcccattatctgtagctccccacccatcctcatgacttttctgagccctgcccactgttgggggtgctgtgagcttctccaagtaccttctcatcccaggccagacacagctgagcattgattaatgaaagggtgtgagggaaatcacagatgataccctacgtttggcaagggagcagcctgtccccttctctggcccctgatggttcatttgtttcttaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggcc

SEQ ID NO: 137235 - DNA, 1050 bp, Homo sapiens
ggtggtgctgagcccggggctggcctctccccttctctttcctgcagtccttatccagcagccctcaagcccagccccctcggccagcagagctgtcagatgaggaagtggctgagctctttcagcggctggcagagacacagcaggagaaatggatgctggaggagaaggtgctgcctgcctgcctgcctgcccatccccacttgaagtgcccttgtgggtgtggggtctgcccgggcccgcctcatgtgtgaacatgtacagtagaggggtctcaggtgggctgggccatcttgcaggtgaagcacctggaagtgagcagtgcttccatggcagaggacctctgccggaagagcgccatcattgagacctacgtcatggacagccggatcggtcagtgtcccctccccggccctcagccctggtccagccttcacctggccctccctctccattctgtgctgcggcttctctcctctcctctcggaactcagcgaagctactgacaagaccatggcctgtggaggggagaacaggaaagcactgtctcttgatctcgcctcctccctcttctctctttctctgtcatctctccactctccattctccattgtgtctctctgtccactttctcctttcctctccctgtgcctcatcttcctctcctctctctctcccttctctcttctccgtttctctttttcaccccactccttcatcttgtctcgctgtctatattgttttccttctctgtatcttcattgcttttgctttctttcaaactttctccttcacagatttttctttattaatcagaatcatactgaccaacatgtgctgaggactttctgtgtgctctgtgcttcacatacagtcatgtgcatctttccagttccacaagttagttatcctcatttctcggggccatagagctagtgagtgacagagctaggttttgtatgtcaaagcctctgtcctacatgacatggcttttcctgctgccttctcccctggtattcgtctccctcttttctcctctggctctgcctg

SEQ ID NO: 137236 - DNA, 1027 bp, Homo sapiens
tccctcatacccctaactgggcatgataccttctggggggctgtggccagacctgggacttgtcttgtaggaatccctgcagcagcagcagcaggaacaagaggaagccctcaagcagtgtcgggagcagcacgctgccgagctgaaggtgcctctcgcatgatggtgttcctctctccagacagtgacgggccctcctgggaggacagaggcttcccaagccaatgcctaagctgctttctgctttgcagggcaaggaggaggagctacaggatgtacgggatcagctcgagcaggcccaggaggagcgggactgccacctgaagaccattagcagcctgaagcaggtcagtggtcactgcacagccccagacacacccctgatcctcagcgtacaggaggggcagggagggagcatgcttcaggcagcccttccggcatctaccagccatgcctgctttctcccacaggaggtgaaggacacagtggatgggcagaggatcctggagaagaagggcagtgctgcggtaagacagagcggtgcccaagcacggctccctcctacctgtagcctccctcctatgggcccactgggcctcagtcctcatgttacccctgtcccccacagctcaaggacctcaagcggcagctgcatttggagcggaaacgggcagataagctgcaggagcgactgcaggacatcctcactaacagcaagagccgctcaggtgagggactaggacagggagaggaggctgaggcatgggggaggtagggcctgggcctgcaggctgcaggttagtcctgcctcttcctcagctgtgctttcctgcttctgtcgctctggaactccatcttttaccttttctctgtctctcctctgattctttctctgcattctctctttatttctatctttctctcgtttttgccctgtctcttctctgtttctgtctctgcctctgtctcagtttgttctctctctttcctctatgtttgcctttatctccttgctttctttctctag

SEQ ID NO: 137237 - DNA, 1350 bp, Homo sapiens
acttcaagaaatagggcaggagaaggagcagttgacccaggaattacaggaggctcggaaggtaggggaacatgagggttgaagggagaggatggggggtaggaattggctcagtccatggggatgggaggaggtgatataaccaaacatgtggggataggagggaaaggaaaattgactggtttctggttgaccagtttcttggccaaatccatgagagtgggaggggaaagaaagaaagtgaccagttctataaggatgggtgagtgccttagccagttcagtggggatgggagggagtggagtttggctagttccttgggcatgggaagagggttggaggccttttttcgatgttgtggaaggaagttgactgccatcgtcctggcccccagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggtgggtgggtagatgatgatgcccttcttcctctaaaacctgggaaccacagcgttgctgataggccagtgggtggcatgcatcaggtgcccgctcctctgccttcctggcccatgacagtctgccccatcccaggcccggacacgggagctggagactctccagcagacagtggaagaacttcaagctcaggtacattccatggatggagccaagggctggtttgaacggcgcttgaaggaagccgaggtgagttggtgatgcctggtgaggaacagaggctgattggggccctcatgtcaaaccacagaagcaggagtggtcaggccctggaacttcccgagattttctggacttagggatatccccacagtcccctggctcaatagcagccctctggagtggatcaggggatggccatcagataggacagactgtcacgtgttaaggctgccctgcctttgtgcaaatttggaaaggcacctctttctcctgaaactgtacttctgtcaggaaattaatgcaatacactgatgttattgaacaagaacctgctgggtgcggtggctcacgcctgtaatctcagcactttggaaggccgaggtgggcggatcacttgaggtcaggagttcaagaccagcctggccaacatggtgaaaccctgtctctactaaaaatacaaaaattagccgggcatggtggctggcgcctgtaattccagctactcaggaggctgaggcag

SEQ ID NO: 137238 - DNA, 1064 bp, Homo sapiens
agacggagtttcggtcttgttgtccaggctggagtgctatggcacgatctcggctcactgcaacctccgcctcccaggttcaagcgattctcctgcctcagccctcccaaatagctgggactacagccgtgtgccaccatgcccagctaatttttgtatttttagtagagacggggtttcaccatcttggccaggctggtctcgaactcctgacctcatgatccacccgcctcggcctcccagagtgctgggattacaggcatgagccaccgcgcccggcttctgcttttctttgtttctagtttctctctagtaaagtgcatgaaatgtactaatcttaagtgtacactcagtgaatcctctcttcgtctctctcttttttttctctctctctccccgccaccatagccaccacccagatcaaagtataaagcacttttagtaccccagaaggtcccctttaccccttcaaagtcagtactcccccagaagtaaccattattctgatctctagcaacataagattcatttcgcttgttctttaacttcatataaatggaatcagctgctctttgtctctgacttctttctggcagcactatgtaagtttatccacgtggcagcacagatctgttctcttactgttgtgtggtattccattgtatgaacataccacatttacccattctcttcattgtttttctgtttgaaatttcctctctcttcctggttctcttcccacctccctccctgtttccctggaactagggggctcataccctgtccctggcccctggggtccctttcactctacttctcatcaccactactttctccagatccaaacagcaaagacccaagaactgaatatgctccgggaacagaccactgggctggcagctgagttgcagcagcagcaggctgagtacgaggaccttatgggacagaaagatgacctcaactcccagctccaggtaacacctttggctctggcctgtctcttcctagttccctagtaatggcccagtgaagtccccagtaaggtggagtgggaagactggagt

SEQ ID NO: 137239 - DNA, 1034 bp, Homo sapiens
aatcctagggcagaaggggcattgtaccccatcaaagcctaggtttcatcatctgtgaaatggagagactcacacctatgtctcagagttactttcagtatggaatgagttaatgtggtcccactatatcttgtgcatgataagtttcatcccatccatctctcagctttgcccattcactcattcattcattcatgcaagcatttacagactcctggctcttatcttaggacctggagacccaggggtgcggcacccagtcatgatatcctgctttccaggcctcccagcctagccaatctataacatggccattggccactatgttgggagcataaataccgggctttggaacctgaaggatctgggtggagataatattgttgttgctgacccgctgagcaaccaaattacttaacctttccaagactctgtttccccatttgtaaaactggtactactcacttgtcagggctattttgaggattccacaagacaacataagtaaatcctggcttccaaaaatgacttaataagaagtgtctatatttattaattttaggtttgtctttatattattctcaatgttatcacttgtctgtacctctctccccagctctccgagaaactgaaaaagaaacaagaaaggtaaatttctttttcccaagggtactgggggccgaggggggaattaacttacggaactgacccatctacatctgtccttctgtgcccagtttttgccgtctgcagacagaaaaggagactctgtttaatgacagcaggtaactgccagatttgcgggtattggtggacaattgggacagtgcccagtgaagattacaggggcagagctaggagactgggcctcaagccatgtccaacacaccccctccccatcactcctaggaacaagattgaggaattacaacaacggaaggaagctgatcacaaagcccagttggctcgaacccagaagctgcagcaggaacttgaggctgccaatcaggtgatggggactgggttctgagatc

SEQ ID NO: 137240 - DNA, 1094 bp, Homo sapiens
tgctgtgacagagagtactggaattttctgtgttgagggatactactttaaaggcaacatctgagcagagcactgagggatgcaaagaagccagttaggtgaagaactggatgagaggattggtgttctgggtagaaaatattgcaagcaggccgggtgcggtggctcatgcctgtaatcccagcactttgggaggccgaggcaggtggatcacctgaggtcaggagttcaagaccagcctggccaacatggcgaaaccccgtctctaataagaatacaaaaattagccgggcacggtggcgcatgcctgtagtcccagctactcaggaggctgaggcaggagaatcacttgaacccgggtggcggaggttgcagtgggctgaaatcgtgccactgtactccaggctgggtgacagagcgagactccatctcaaaaaaaaaaaaaaaaaagaaagaaagaaaatattgcaggcaataaaataaaaattctctgtaggcctcgatattctcatctgaaaatggggacaaggaattttctcaggactgctttgagaagtgtacttcagccaggagttgggcagggggctggcttagttgtattggcattgtatacctctccaagactaacggctggcaatgcaggagctgtcatcagtgttggccctggaaatgccctgcgagctctttgtggtgcttaggatgagagggagctatctctgggcccaggatccagccctccacagaagaggggttgcagtgaggctgtctgtagcactaacaacttccagaggagcctgaggtcttggattgcatctctgaggttgggagtaggaagaggaaaatggtttttggtgtcctcatacttggtatgctcttggtattctctgactctgccacttaaaagatgtgtgaatttgaacttgtttaacatctctgtgcctcaatgtccttatttgtaaagtgggagggcacctatatcatagggtcattatgggaattaagtgaattgtaaagtacatggacaaatgctatgtaggtttcagcaaatactgctctgattctctgcttctctgccccttctcttcctctgttca

SEQ ID NO: 137241 - DNA, 1360 bp, Homo sapiens
tggacagatgtagcaatgaagccacagtttctgagtctggagatccagcccataaatggttaaataccagggcatctccctacctcccctgtccccccaccagcctcaagagcttccaagaaaggatgatttatgtgtgctggggccccagggcaagacttgcattcattcactcactcacacactcattccatcattcctttgggctccaaattgtcacacatgttctgtggttgaagatgctcccatcctgcaacccctgtcatccttgtcctcccaaaacgcttggcacaattgtctccatatcctagtaaggcagtccatctctgttcactttagctctcttcccacccacccccactttaggcactgagcaagagcaagaaagctcaggtaaggggatcccttgtgggtgagtgtgactgggagatgtcttggtgggctatttctgtatgctgatatttccttgtactggcctttctttctttgtgtgcctttacatctgctactacctcactgccatgtgttgctgtatctgtccttgtttccctgtatttgtcctaactctgtgtctctttccttctctctctttccattcttttctctgagtctctttctgtctctgtctgttttcctgttcctgtctctctgactcatttctcttcccaatcttctctttgtctctccccctcctgttcctgtctcggtgatttctcttttttctgctttctctctctaactccttgtttcttccaccccattcctctctcttcctaactcatttcttttcctgacccctcctcttctccctgttctgttctctccctgttgatttctgtttgttcttctctccgtctttttcactctctccctcccaatccctctccccttttctatctctccccctttccccatctctacttcctctctccccaatcattatcttcctgtcttttcctccgctctcttcctccctgtattcccttctctctaccttcccatgtctttatcttcctttccctgtctctcattttatccctccccatgtctctttctcctatatcacctcattctctgtaccctatgtcctctcccacccatgtcattttctccctctctctgtttctttgccctacctccctatcctttttgcccttgctggagtcctggcccttgtctgccactgcaggaagtcgaggtattgctgagtgaaaatgagatgctgcaggcaaagctgcacagccaggaggaggacttccgtttgcagaacagcacactaatggccgagttcagcaaggtgctggtgcctgggatagtcaaaggggaaatgaggggtaggggtcatctgggctgaaaccta

SEQ ID NO: 137242 - DNA, 1034 bp, Homo sapiens
ctcgtcggtttcgttctcttctctgcgtctccaaaatgctgcccttcggaattaggttctaccccctccattcctggccagtggtttggtccgaccttaatactgccaggaggcgcgagctgcgtctgcgcagaaagctggcgggggggtggggggaggaacatggcgcaagctctgtctgaggaggagtttcagcggatgcaggtgccgctcgcggtgggaaagaccacccggctaggcgaccgggggcggggtagcgagaggtcgtgctatcagctctgagaaggggttggttgggatggaccctgagtttatggggtgggtctggagaagggaaactgaggctcggagtggtgagactattggattccgagatactctgcggctttgaaggttggactctgttagcattgtgggctgggagagcgccattaagtaggcggtaccttactcagacctggaggggacgagacttttgggcccgtgcaggggacaccgtcggcgggtgatgataatgggctttgagggaaggagatcctgagaaggcgaaaccattttgtctggagaggaaggaagcgggtgttgggtcgtttgcgtcatggtggtgggagcccttgagagggcagaaccattagcgggtgggaggtggtaagttttgggggagataccactgtgcccggggattggggaaagaccccagatgttgtcattgttcctgggaggtggagatcctgtgccattggtggttggtagtgcatcctaagagggggcggcaccattggatgattaagggtgatcccattaggcctggggtgaagaaggccatgaatgggtaataccattaatcccattaactggggggaggaccagaggggtaaaagattgataccttggactacaaggagggaagatcactgggctttggggaggtacccccacttgattcttttggggggactctgagatgcaatgaaaggccatagcattgcactatgaatgggcccttgttgagagggttcctcactggggggggg

SEQ ID NO: 137243 - DNA, 3716 bp, Homo sapiens
ttttcctctggatactccatacctttgaaagaccccagcctcaagttctaagcatgtggtgggaggctcccacctggtgcaatccccgcctcagctcctgagaaactcctcatgtggcatttcctgcttgcctcccacttgggccccacagggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggtttgaaaagaggagatggtggtgggggaagagggggagagcttcctgcaggtggaggcagagagagagcaggccagggtttcccttcctggcatacttgggggatccctgggcttcccagatcacacgatgatgatagtgataatgataaataataatcataatattaacaaggataataatattgctaatgtacatagcatttatcttgtgctctgtactgtgacaagagctttatatccactaacttattcaatcctcagaattctatgagataggggccattattttatttatttatttatttatttatttttgagatggagtttcgctcgttgcccaggctggagtgcaatggcgcaatctcggctcaccgcaacctccgcctcccgggttcaagcaattctcctgtctcagcctcctgagtagctaggattataggcatgcaccaccacacccagctaatttttgtatttttagtagagatggggtttctccatgttggtcaagctggtctcgaactcctgacctcaggtgatccacctgcctcggcctcccaaagtgattacaggcgtgagccaccgcgcccagcctaggggccattattatatacccactttacagtttgcgactctgaagcttcagagatgttaagcaccttgcctaaagttttggaactagtgagtagcagaagctgaattccaacccagggaacctacccttttcaacctttatactcctctgcctctgagggactctgaaccctacttatcctgcacccaacccctattttttacaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaagagtctcctgtccttgttttacactgtgcagtgaacatagcccatgcaggccaagagggataaaagtccttgggagaaacagattccagaaggatggataaaagaatttagaaaggaagagggcatggaggaagacaatatgcaaacaaaagacagtatttttaaagaccaatcaccaggcacaattttaactgctgcaagtgtttcatctaatttatttctctaaagggatgttagtcagaacatgctgcttcttacttccatttggtctttgaagaagctgaggaatagaattgaactgttctgaagatatgcaagcctgtaaatgggtgaggcggtaaaacagtaaagtcaggtgagtgagggctcgattgaaaaatgccactgagggcagagggggaaagaagcttttcttgcaaatccacttttgaaactgataaagaagtctatgaggatatttcctggcagacaacagaggtatttaagatggtggaaaggacaaagacaaatatctgaaaggcagaggaacaagcaaccaactgaattttggaacagatgttgagattttgggagaatttaaatgaacacaagtatcttcttgaaggctgggaaaaagtattttcccgcaatttctcaaccagacactgactcctagaacaagcatcaggcctggtccctccatttcccccaccagactgtgacctctgagggctggaactgggcttggtcaccgtgactaccc

SEQ ID NO: 137244 - DNA, 1271 bp, Homo sapiens
tttgtcccctttccccctatggcttgtggtcttgctttcaccccacttcagttcctctcgtcttggatttaacaaccagcctatcaccatggcttaaaatagtaaaaagaaggcactttttaaaaaaggcatttcccctgcttttggctaccaaaccctaccttagtatctgcatgtgtttcttgccttcctgtgctcagaggccctgatcactccactcttttccagagaccgaggcaaaggcccttttgaaggaacggcagaagaaagacaatcacaacctaagtaagccagagagcgtgtgcattgcccgggtgctgtgcaggcctgcctcaccccgagtcctggccccccatggggaactccttccctgcaacagcctcccaactccctactttctgtctcttccatttttggctaattgacaactctttctcccactctttcttcctctcctcccctctccaaagttgagcgtcgcaggcgattcaacattaacgacaggatcaaggaactgggcactctcatccctaagtccagtgacccgtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatggagtctcacgctgtcacccaggctggagtgcagtggtgcaatggtacttcctttatttattcaagatttatttattggccgggtgtggtggctcatgcctgtaatcccagcactttgggaggccaaggcggggtcgatcacctaaggtcaggagtttcagactagcctggccaacatgatgaaaccccgtctctactaaaaaatacaaaaattagccaggtgcagtggctcacacttgtaatcctggcactttgggaggccaaggcaggcggatcacgaggtcaggaggtgaaggccaacatggtgaaaccctgtctccactaaaaataaaaaaaatttagctgggcgtggtggcacgcacctgtaatccccgctactcgggatgctgaggcaggagaatcacttgaacccgggaggtggaggttgcagtgagccaata

SEQ ID NO: 137245 - DNA, 1024 bp, Homo sapiens
ccgggaggcagagcttgcagtgagccgagattgcgccactgccctccagcctgggtgacagaacgatactccgtctcaaaaaaaaaaaaaaaaaaaaaaagagattaaaactcatgaagaagtgggatttggatatactttattttatttgtatttatttatttatttatttatttatttatttattttgagatagagtcttgctctgttgcccaggctggagtgcagtggtgtgatcttggctcactgcaacctctacctcctgggttcaagcaactctcctgtttcagcctctcaagtagctgggactacaagtgcaggccaccatgcttggctaattttttttgttgttttgtatttttagtagagacggagtttcaccatgttggccaggctggtcacgaactcctgacctcaagtgatccgcccgcctcggcctcccaaagtgctgggattacaggcgtgagccactgcacctggccctgggtatacttaagattgacgtgctcctctggagtatatccaggaaagtgtgaaggagaggaaaaaaaaaaaaactaggctgacataaagcagtgctaattgaatagttggataagaatctcctgagagaacagaatgtgcaggaagatactggagtcaggaccttggtccacagcagcaggagaccctgatgtggaagatggtacaacttgatcagagtggaagatggtacaacttgatcagagtgaaagactggagattaggttggaattctccagaaggccagattttggatagaatgttgtcatgacaatttaccaaggtcggagaagattgggttggagtgttccaagaatgctggattggaatgttgtgctgggaggagctaacggactggaatgtcccatcagagccgacaaagacctgagaagggtggttttccagcatttcttctcagagccagccccggggtttgggaaaggggctttagaggtcactgagggatatgagggactggaggaagtgataagcaggccaggca

SEQ ID NO: 137246 - DNA, 1393 bp, Homo sapiens
cccaggcaggggaagaagaggaacctggggcttctcctatcacctgacgcccacccccaggagctcagagagcttctctagcctcacattgggcttaggagccctctgtatccacattctgctgccaaagcctcaattctgcttcttctgctctcctgtaaataggacaaacccccccttgcagagctgaacaatagcatctccacttaatatgtgaacaggctcaaatctaggcttcaccataaggaccaaaggctaaaactcccccaccagactgacctccagtgtgtcccccatcagactgtgacccctgagagccatcaccaagcctggttcctgtgtctctgcttctacattgtggcctcggaaggcagagaacaggcctggttcctgtgtctgctccgtcacgctaagaccctttaggcttgggatgagacttttagcttacctaaaatatggccccatatttcccattccacagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtaaggtgagatccagaggccctgggagggggctcctggtgactgaggagtgatcctaggagctagggatggcctcgatgcactggtgatttgggggcaaggtcttaggggctctaaggaaggtccctggtactgtttaaattatctgtgttcatgtctcatgtgttttgggtttctgagatgatcttgtgaaattgcgaggagttcgtgggggccatgaggatgtcttggtggaccatggaggctcatgagtgccccaagtgggccctggctttgtaggaagagcttcatgtgtgtgggatacattagttctttggccattagggggtcttgggaagcattgtatggttcccaggtctattaggtggtgtcagagactaggtggggaatcttggggactgtgacagggttttccagaaactacgagggatcctgtcagtcatgggtggatcttggcagctgtgaaggatttctgagaaagagagtttgggtcctgggggagactcgctaatatttttggggtgttctcagattctgggcccagcttgtctgcgtgagtctaggcaccaatgagttaggagggtcaggctggggctcagaattcaccc

SEQ ID NO: 137247 - DNA, 1021 bp, Homo sapiens
cgtgagaatcacttgaacccaggaggcagagcttgcagtgagctgagatcgcaccactgtactccagcctggtgacagagcgatactctgtctcaaaaaaaaaaaaaaagtagggggtatgggggctgggagaactctgaataggaagtcaggaatccttctataaagtgaattgttattcctaaattctgttttcctcaaacccaggttgttacagtgtgggggttgggatgcaggcgttcttattattctgactcctaagggactatgagtaacacagtggggaagggaaagggggatgggggaaggaggtgggaattcatggtggtgtggtacccagcaaggtggccaaatatgaggggcttgtaccctcctcttcgttctcccccgctctctgtctctttctctgtctcaggggagggctggggaataaggtccttcattcaatcactgaccaccactccacctccccctcagcctgaactctttgcttccggaatccgggattgttgctgacatagaattagaaaacgtccttgatcctgacagcttctacgagctcaaaagccaacccttaccccttcgctcaaggtatgtatgacttgtctatctgattcccctcccaattcctcagccctcctctcccctcttgatgggcagaggccctcagtaccagcccaacccattctttcaccagcctgcgttttctagtggtggtaaaattagggaccagaaagagcatgtcacacaggaaagtaggtggccaagctaggattccagtatctctgtcaagacctcccctgcctgcccccagcccacctgcacacccattcatatgcaagtgtttcagcctcaggtgttccagccggcctggagtgctcagagatagggcgtggcctgcttaaactcatgtccccgggtgggcggggacatgcctctagccccaactcagtcccttcccacactaccaactcacccaccctcagcccttgaggagcccctgctggtctcttctttcccc

SEQ ID NO: 137248 - DNA, 1059 bp, Homo sapiens
ctgtcctttctctgcaccctatgtgatatcctctcctatatactcgtgatctgcatcctggctcaccaccttcgtctcctgccttgtccctgcccctgactctgccccgtttttccctcttttcttgtcccatcaccatactcattcctatcctcattgtgtcctggtcttttcctgttcctgacctccatcctgaacctgcccttttccctgtcccctcctttgaccactggcttagcctttcctagtcatgtcttctgactgctgttctatgttaatcctgacccctgccctgctgttttgtctctttcttgtactttttctctgacccttgtcctgaaccccaccttatcccatcccctggccagtgttctggctcattccccatcctgcctcttgacctccatcctgtgataactctggctctatcttgtcccctacactccttcctgttctgtcccttcccatcccagccccagggtgttcttccccttaccatgcccctccaccctgttcagatcttcttccttcctaatatccacttgccatcccttctgagccgaggacaggggtcccattatactgtgcccggaacttgaagattctgctgttcccaggacctccgaagtacatcccaaatgcttctcttagcaagagcaagcagccctatgtgccctgcgtggctgatgggggtttttgtgtgtgatctcccctatccccaccctagtgatcttacatagagcttacatttctcttcctgccccaggagggcatgcaactgttcctacgcccctgccctctgcaagtgtgaaagaataccctaaattattcagtgactctctgggagtctgagaggtctgggtcatgtttccagtcttgctgtgttggggactgcctcatgttggggggaagagttaagaaaatatgaagagatgggggacccaggggtatgtatgaatcttctaggccatgtttgattctgggtgcatgatccctgctttcctggactgaaaaagaagaagtctattctaggccaaggctttgggacttggtatagag

SEQ ID NO: 137249 - DNA, 1023 bp, Homo sapiens
caggatgtgtgctgtgtgccgggactggcccagagctcaggtggtagtggtgatggtggtggtggtgatggtggtggtggtgggcggggtgaggggaggcagggacagtacgtcgtaaggactcaaagctctcatttccttctctggcatgaagcctgactctctgaagaagagagacccagcatggatgtgaagaagcatgagcccccttccctacttctccttcccacttgcaggagtagcctctgtctgcctcccagccaggacccagcccccggaaattctgatttcacctgctcttctgccactgtgatctgaatcaggcctcttcacctttccaggcctcagcttctgcatctataaaatggctgtgaggaggctgggtctgtgccatcctgctacatttgtaggaaccaagagggatcaaaacccataagtgttttgtagggtgtaagttgtgcttgatttattgagattatttcttctggagccacagaaggatcttgagacctgacctctccttagaaaggttgacttcctctgtccccaacttgggaaactattattccccagtgagggtgggaattgccccaaggccttctaccactgccttgccctgggaggaaagggtaggggcctcagaatgtgatgcttagtgccaagacacaaaaactcagtttacacccgaagcctcccatgtactttacagctccccacacctctatggcccagatccaagttgccccttgggtgggcagcgtctaatcctctgggaatttgggcagtaggagaggcagctgctactcccaccactctcagcccttcttcccagttttctgctaagtgtacggggtgaggaggcacaggcctccatgcctggccagttttaaaaaaaatttttgtagagatgggggtctcattatgttgcacagtctggccttgaactcttggcttcaagcaatcctcccacctcagcctcccaaagtgctgagattacaggcaccagctaccctgcctggccca

SEQ ID NO: 137250 - DNA, 1050 bp, Homo sapiens
cagctccccacttgctgtgctctcactcaatgcgaagggaaccaaggtaccagggccaagtgggtccagacatccacacggattctgaaagggcaggtcaagcaggcacgtggggcccaggttaccccttattccccgctgtggcatgggaagctgggaagggctgggggttggggtatcatgggatgtgcttccttaacggttcctttgtgtcactgccagactttgtccagccatcagccacggcctctcgacagcaccaagatggaagtcaaaggtcagctgatcagctctcctaccttcaatgccccaggtcggtggctgcttcccctcctgctgcctcctcccctgctctgaatcaccacctgcttgctcgggaagagttggtcccttgccccacagctgctccagaatgccctggctgtcccactgatctttgctccctctgtgtccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggtgagggcctggccctaggggtatcaggcggggaggttgggaggaggtgaggagctggggcccctaggtagacagacttgggtggcaattcctcaaccacttgtcttggctgtagattccctgtcacctactttctcctcaaagctcagcttagatgtgttagaatgaatgaaataggctgggcgctatggctcacgcctgtaatcccagcactttgggaggccgaggcaggtggatcacctgaggtcgggagttccagaccagcctgaccaacatggagaaatcccgtctctactaaaaatgcaaaattaggctgggcgcggtggctcacgcctgtaatcccagcactttgggaggccgaggtgggcggaacacgatgtcaggagatcgagaccatcctggctaacacggtgtaaccccgtctctactaaaaatacaaaaaattagtcaggcgtggtggc

SEQ ID NO: 137251 - DNA, 1052 bp, Homo sapiens
cgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaaggtgagcatcccctggtgagggtgggagagtggacactggcaaatggacgtggtagggctgggatgggtgactggccggtgaaaaccgggaggtaggcacaactcaagtggcccaacccgtgagaagagttgcgacaaactggcttaccggaaaggacaaactgtgggggactgatgaatatctgccaggacagtcaggaaccaaactggggtggtcttgggctctggtaaaagcagattcttgggacaggaacaggatgaggcggaaactggccagaaggtggcccaagtagaggtgcccacccagtggtgtaagggggcagcacccaggcctgggagtgagaggcccacttctccccctctcacctgtagaggacgtagttctgcactcagagagcagctccctctcagagtctggggccagccatgacaacggtgaggactcctatcccccaaacctgcccccgactcctacgtccctttagcccatcccctttattcatccgaccacatcctgcatgatcagcccatcctttgatgcccagcccctcctgtgctgcttcagcttctccttagccatgctccatcttcctatgggtcccccatcttcttagcctcaccccaccccagccccacagccccagaacctacttgtcagccttagttcctcctcagcctgcttaacctgtcccagcactttgcccctccccatggccttgccccccagcctgtcctgccccctctgggcccccctcattgaattctatcccacttgctctcttccactcagaggagccccatggctgcttctctctggccgagcgcccctcaccacccaaggcttgggaccagctgcgggcagtatc

SEQ ID NO: 137252 - DNA, 1061 bp, Homo sapiens
ggttgcagtgagctgagatcaacatcgtgccattgcactccagcctgggcgacaagagcgaaactccgtctcaaaacaaacaaaaaaacaaaaggtgtgggacatgggaggctgggcattaaaggtgagcaggcatctcggtggataatggggtaggagtcagtctcctcatttgtgaaatggaaataataatatctgcctttgaaagacatggacataataagttctggttagcatatactgagtgcctgccatctgctaggaattagtgttttacgtggcatcaactcatttaatcataatcagatccctgtgaggtgggtgctattgttattcccattttatagatgaggcaagtgaggcacagaaaggttaagtaacttgttagtaaactgaagtcctggagtttgagcccaggcaagttttactctagagtccatgcttttaaccactgtcctcttctgcttcttaaacagagtgcctactttccccaggctctgaacaaaaccaagtccccttccttgtggggcttgcattctgtgaacggtggctgttgggatggtagctttgggtggttcatacgtatggtgggatagagaattcaggcagggttttacatgtgagccctaaggcctaggacttaatcctggaggccgtgcgagccgagccatgagaacggccttagcagggggaggggtcagctggattaggaacagccccctgcccggcatctactctgctagcctttcctctgagtccctacacagatttacacctcccttggagctaacagtgccaggcctcccccacgcatttctacccctgaccgcctagcctaggatagaacctcagctgccctttacatgtcactacctgccacctttatacacacagcttccaaccttgggcccatttggagatgtgaaagtgaaggcttagaaagggctggggtagggagggcactgcacgccttctgcctgatttttctgaccctattcccatgaccctcgcctctcaccccagacctgaaggccttcattctcgtcagtggtccggcagcc

SEQ ID NO: 137253 - DNA, 1038 bp, Homo sapiens
agatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctc

SEQ ID NO: 137254 - DNA, 1435 bp, Homo sapiens
gcctcctggtgctctgggtcgcgggcggcgcttgcaccttcctgttcagcatcgccgggccggtgcttcgtgagtctccactaccccgagatagccaggaaagcagccagagcatgcttaaggcaccaggccagccctgccggtccccgggttgagagggggctgggaaacccgagggcctcgccacgcccccgctaaaagcgccttcccgggcttcgttcccccttctgggaacaccccttttattatcgcctttcctatctcactcttggtgttaagtgccttccactggccacgtccccgttaccgggcgtcttccctggccatgcccacgttgccaagccaattactcggccacgctttcagtatctgaggcgtcctggctgctcaccactccattggcctgcctgcgcgccaattcccttcggtgggccccggttggctgcaggctgaggtctattccactgaccacccctctcggtgccgcccacagtgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaatttgagcctcctgggtaaagtccttgtacatttcaaaggacagaagtggcctacttttcaattctgctagactcttcctgaatatgtgggct

SEQ ID NO: 137255 - DNA, 2879 bp, Homo sapiens
tctcggattcctggcctcccacaggcaccccaaggtactggcagatgaagacgtcagagtacttcagagtcacacagagaggaggcctacagcttggaagtcatggatcttatagcttgagaagcttggtgctttgttttcattttaaaaattctgattgagtgcctcctgtgtgccatgccctagagcacttactgtgagcctggaactgccctaagcactttacgtttattaactcatttaatcctcacagtaactctatggggtaggaaggatcattatccccatctttaccgatgaggaaactgaggcccagtgcagttaagtgactcatccaaggtcacacaagcaataggttttaaaatcttggagccgtcttcccaatacccccttggcttgagcctcaagtgccatcttactttaagggtttttcttgatgatcccatctggacaaggcaggagttgccctaggtgagtcacagagccctaggattcctcacggaaatctccagggtgcatggactaggaccctggaggcagaaatagttaccgaggggaagttacaggcctgagtgtgagtccctgtttggttgctgatgagctttgaggtccttggccagacactcaaccactttgaacctcagtttcctcatctgtagatgagtgtaacagtctagaacactcctctcagggatcatatccacaagtgctcgtgctgtgcgaggatctcactggttgtttattgaaaggctaagcaagtaggttgaggtccctgggaagcaggggtggatcctgtgtcaccagggctgccccttaccctaaaccttggccccgacaacccacccacctgcccagcagtgctgatctgggacgatgcccgggagggcaaggactccaaggagaagctggtgctggagttcaccttcaccaagccagtgctttctgtgcgcatgcgccatgacaagtgagcctgaggaggaccggggtgggaggtaggaggtccccacagtaagtgagagggatagtcctccctgggcatcccgccaccccctcacggccatcctgtgttgtgtgatacccacaggatcgtgatcgtgctgaagaaccgcatctatgtgtactccttccccgacaatccccgaaagctgtttgagtttgatacccgggacaaccccaagggtgagagggctcagatacacaggtgtaagggcatgaaacagtggatggggcagaggggcagagatgaggaaagaaaggaaggggcactcacacacagagaaatggggaaagaggcagggagatgctcacactcatagcctctccatctttccagccctcagccagttctccccacctccggacctgccccacccctgggtaccccagtggcagagcaaaaacacctcgtgaggacatgggtgggtgtgtcagggatccctgagcttctggggctgtgatagcagcttactagattccacagctgcagagcaaggaatggaatctgcctagctggcggggcgtgcagctgagctgagccccctcagggttcttcgggttaagcttatcgtggagggttgaagtctggtcctcatccagctctgtccattctgagatgctgcctcctcttcagccgcccaccccaccccccatcttcacaccctagggctctgtgacctctgccccagcctggagaagcaactgctagtgttcccgggacacaagtgtgggagtctgcaacttgtggtgagccgtccagtggacaagggtgggtaggttggtggactggcttccttgtggactcttggccccttccctccataccaccccaacctcagactcctccctcctaccccaggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactggtgagcacagggtatgcatggtgggctggtgaccccataccacatgacatgtgggcatcactgctgatctgtcttctagcattaacttcagccacgactcctccttcctctgcgcttccagtgataagggtactgtccatatctttgctctcaaggatacccgcctcaaccgccgctccgcgtgagtaccccctccccaccctaccgtgtccctgtccccctgcccatttaccatacctgggcttagccagtgctgcctgcaggctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattggtgagtgggaacagccccttggttgggggtactgcatggggcaaaggcctgcaggttggacctgaaaggattttagggccatgtgaggctcagcttcatcatcagtaagggggacagcactgggcaaaggcctggaggcagaccctaggtcctgagatgcctgagaggactggagcctgtggctgtggcagcctctgaccttttaccaccccccctcccccagccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgctt

SEQ ID NO: 137256 - DNA, 2266 bp, Homo sapiens
actgcactccagcctgggagacagagcgagactctgtctcagaaaacaaaactaaacaaaacacaaaagacaaaactcagagctggcggggttggggggacagggtggggagaaagaaagcgaaatctgttccttggcttctcggagccaaggaggtttctccactttcaaggtctccaggtccgcccccgcctgtaacccccagcgccgcccctctggaagcctgggaggactgtgtgttgcgaaccggtgcggctactctcggccgccgcggaggtccgcgtcttgttagcagggaaggtttactcccccattgtgggtgaccaaggggctgagggcttggccggtttcgctttgctgggggcaaggcacgctctctctccccacccttccgggttccctcagacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctggggtgagtcatttcctgcgacaggctccctcccccggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccagggttggttgggtctgggggaggctggaagtctttcgagtaggggtctaaggcagaggtcttgagtgggtgctggcgttggaaggagcatgcggctggtcttgggagaggggcgaggcatcccggacagagtcttggaatggaggtgcaaaaaaggggtgttgaaagttggagctgtccagagaataactctaaggcagagctgtccaaagaaagagcatgaggcattccagtggagggtgtaactgaaagaaaggaaggagatttggactcttggaggatgggggagggagtatgtctggccagagttattggggagttgaggatttgaagggaagttgggggctctatggcagtaatcttagtaggggactgcgcaggcatcttaggggttgaggttctcctaggtaggagttttgggtggtttgttttgggcaagggtcttagaaggcaagggtgccctggggcggggtcttggataggggtctagagggggaatcttaggaggatggggggggttcctggggttgggtccaggccaggttatgttgtagtcaaggacagcagaacacaaggaaggagatgtcccaggggtggaaaatttagagtgctagggggaatcctagggtagagtccccagggcataagccaatctaagggaatgtctaggctggccctgaagggtagttaccaaggcatgagaaggggtcatcccaaggtaggcatcctgaaggagtttggggaagccggttgagggggaaaggtgtgagaggactctggggtggtcaaataggttggggtacagttagaagggtatgagcagaggagttcctggggatggcagaccaagcatagcagtcccagggccaagtcagggaggtacaagaagtgcatctcctagcccacttttgtctatttattgagagagtccggtgctaggtcaggtttgaagatgagaaatgggttgggagtggttccaggccatgtctggcattgggatcaagattggctggcggtggggaggagatatcacgggggcaccccctatcacattacttcctgacaagtcagtgagggccagcatgtaaagaggaggtgtggggtccacgtcagtgtgggcctggagcttgccaaacctgaaagaaggagggttcctggccatgttgtttgggatcttgggagcttagagcagagaccctgggactctctgtttttatctttttcttccccccgagacggagtctcgctctgtcacccaggctggaatgcaatggctcgatttcggctcactgccatctcagcctctcgggttcaagcaattctcctgcctcagcctcctgagtagctgggattataggtgccccccaccacacccggctaacttttgtatttttattagagacgggatttcaccatgttagccaggctgatctcaaactcctgacctcaggtgatccacccgccttggcctcccaaagtgctgggattacaggcataagccaccacgcctggcctgttt

SEQ ID NO: 137257 - DNA, 2253 bp, Homo sapiens
gaggaagcggaaacaccttccagaccggtgggactctgagcatgcgggaggggtcaagaaggcagggctgtgggtaggctcgagcagccagggaaggcttccaaggcaaggcgggctcatagaaggaacggggaactgcattgtgggtgggtttcatagcataggcaaagggagggcaactggaaagtgcatctgatgaagagctaagcctggtgctggcaccttctccacagacaggatgggcctgcagccaagagtgagaaagcagcccccagaagtcagcactggttgcacagggacctgcgtgtgcggtttgtggacaacatgtacaaaggaggccaatattacaacaccaaggtgggaaccctgcagcctgagtccccctccctctcctagggactgggcccccctacctctctaaaatctcacatccccctgacctgtatccccagatgataattgaagatgtcctaagcccagatacctgtgtatgtcggacagatgaaggccgagtcctggaaggtgagtttgagcgatggcagctggaggttgatcaagaagagtgttttaggcccagagcctggcccaggcaaagctgggaggtttggcagagttcaggtattttgcaaggcctagcatcctcttacagaacattagacacttccatgatggtggttggttatcttgagccccactctcccagtctgtcaagttttctttttttttttttttttttttttgaaacagagtcactctgtcacccaggctggagtgcagtgactcaatcttggctcactgcaacctccgcctcccgggttcaagctattcttctgcctcagcctcctgagtagctggaactacaggtgcccgctaccacacccagctaattttggtatttttaatagagacaggttttcaccatattggccaagctggtcttgaaccccttacctcgtgatcctcctgcctcagcctcccaaagtgctgggattacaggcgtgagccaccgcacctgaccaggagttctttcaggttggcttctgtatcttatgacatgctgagattgggtctcattttatcacctatgctggagtgcagtggcaccatcatggatcactgccacctcaaattcctggtttcaagccatcctctcacctcagcctcctgagtagctgggactgcaggcactgaccaccatgcctggctaattttaaaattttttgtaggctgggcgcggtggctcatgcctgtaatcccagcactttgggagaccgaggagggtggatcacctgaggtcaggagtttgagaccagcctgaccaacatgtcaaaaccccatctctactaaacatacaaaattagccaaacgcagtagtgggtgcctgtaatcccagctactcaggaggctgaggcaggagaatcgtttgaacccaggaggcggaggttgcagtgagccaagaccacaccattgcactccagcctgggcaacaagagccaaactcagtctcaaaaaacaaaacaaaaaaatctgtagagatgaggtctgaccatcttgcccaggttggtctcgaactcctgggctcaagcgatcctcccaacttagcctcccaaagtgctgggactacaggtgtgagccaccacgcctggccaggaaaggcccttctgacaggacgctggttgggctggtccttgctgtgggcctcactcccctctcccttatccataggcctgagggaagacatgctggagaccctggttcccaaggcagagggtgaccgtgtgatggtggtgctgggcccacagactggaagggtgagtctcagacctggcagtagaggtttgtgggtcgttcagggcctgtcccaggatctaggcttgccttgctgattccacttcacctctgttccaggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttca

SEQ ID NO: 137258 - DNA, 3803 bp, Homo sapiens
ccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccagctactcaggaggctgaggcaggagaatcacttgaacccagaagacaaaggttgcagtgagccaagatcatgccactcactccagccccagtgacagatgggtgacagagtgatactgtgtctcaaaaaaaaaaaaagtatgacttgaattgtgccccctacgggtagggccacagtgtggcctccctgtgttgagaggtataggaggagggagagtggggtaggatgcactctcttggcctttccctggcttaccaacccggtgcttgagtcccatcctgcgtggggcaggtgctggaggtggtggatacaagaagataagagactgagtaacctgaccagctaatctaaaccccctcactcctatcctgtcccccaggtactgggcctaatcgctacgtgcctctttggctatgatgcctatgtcaccttccccgttcggcagccaagacatacagcagcccccactggtaagtgtgtgtgtgtgtgttggttgggggtaagggggttgctgagagggcagagggaaaaaggaaagggatctcttaaaggcacgaatgccaactctggtctcgtattggtacttagggcttttgtaccaataggtaccataagcttcggtattcttgtgtgtaaaatgttcatggactttggatcttgttttaaaaaatgggcatatagattcagccaatgctttctctcttttcctcacctgcagaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgagaggc

SEQ ID NO: 137259 - DNA, 1082 bp, Homo sapiens
tcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccacctagtctacccggctctgatttctcagtgtgtctttttcgggcgccggggaggaggttggccgggggagaaaggagggagaggtggtgagaacaagctccacccggacccaccgaccgcagttcagcttgctgcaccatttcaggccccttcaaaagtgttaggcagagcagcatcctctgggaagcctctcctgccaatcactctgtcactctctgagtagccctgctcaccctcccactactggccaccaaatgcccggtctttctaggagttggttctaattctggtcccttagccaagcctcttccgagcccctgtggaaccctctcctcaaatccccaaggggtccgaataggaggaaacctcacattgcctgaccccatccctaatcttcagaccctactgtct

SEQ ID NO: 137260 - DNA, 1055 bp, Homo sapiens
aaaacagatgcaaagagaaacagacgcagggagagaggcaggaaaacagggtgagggagagagagacacagagagaaagagacactcagaaaaaagagaaaccaacacacagaggcaagagggagacagagagagaaccatccggagaccgagtgagagacaggacagagagacagagacaaacagaccaagaaacagaaagacacagacatacaggcatacacttacacagacagagaaaaaagagacaaaaagagacatcgacagatcagataggcagaggcagagaggatcagagacacagagagacaaagagacatctgagaaagacaaagacacatagagaaacagagataccgagagaaacagagacacagtgagatacacagagaacaacagagacaaacagagaagagggaggtcagcatggaaaggcagagacagagagagacacagagagagaaacaggaagagacagccatacccttgtaatcagcttgtccttggtcccgatgagccctgattagggggtgggggtggggactgctccatctgctgctgcctgtgctgggcccccgatctgtccagaggagggcacctccctcccacatgcacacaggttcactgtggccatccccatccctgctgcccaaggtcttcgccatcttcgcctttgccacatgcggcagctacagtggggagctccagctgagcgtggattgtgccaacaagaccgagagtgacctcagcatcgaggtcgagttcgagtaccccttcaggtgtgctcccaccctgggataccaacagacctgggagaggaaggggcagggtggaaccggccaatacctccccccgcaagtagctcctgcccagctcccacctcgaggctacatccactgggatcactgagcacctgccttgtacctggcactgctctggactctaggactatgtggtgagcaaggcagacataggctgtggccctctggctctgttccagcgaaggggtaagggacaggcaataaacaagatacaaaagtaagacaggtgtatat

SEQ ID NO: 137261 - DNA, 1046 bp, Homo sapiens
ctctggagtggggctgactcccactttggatgagacctgtcccgtgtttcaaccagttcagtttgccccgagagaaacccagagccggtgcctggcacatagtaaatgcctgataagccttcagtgagcgaatgtaaccccaaaggctgggtgaagagtaaagctggggcaagaagcagagaggacctctgggatctgtgtgggataagagtaggttactgttaggtggtctcaggaaagccaggtgggccctgagtgggttccccagggctgggagccctgacctttgctgtcacctatgttgtctactgatggatttaggttttcttttctttctcaggcagaaagtgggagatgggagacagagcgatctcaatttagccaccctaaaattcctgttgccgtcagaggacccctctgcctaagatgcatcacataccaggccgattccaacctccaggcctctcccctggcaggattcttctctgggtttccttgtcctttccttctcatccgtctacccttcctagtttgacctggctgagccctggtgaaatctctgcctctcttcctctctgggtccaagcacccctcacacccgctctctcccctttcctccatctctgtccagtgccctccccctcccccctcctccactctgcctccagctttttttggctgctgtctcttcctcctcctcctcctcctccctccttccctgacgctgaataatcaggcctggctgtcctggtttctggaaatacccgtgtgtgggcagtggctcagggctagaacaggggatggatggatgggggcccctgggcagccccagacccccagtgcaaagacaacaaaatccagggatgtggtccatgcctgcctcctgctggggaggggagggcaggaggtttattgagcagttggggaggggtgggaattcagagggcgtggacgcaggccatctcgtctcccaagtcctcctcatcgaagcgggagaggatggactcctcgtcgctatagagagagctggttccctgtgccagcag

SEQ ID NO: 137262 - DNA, 1050 bp, Homo sapiens
gcccaaatgaacaaggtgagatatgatggagcagatatagggggtgatggtggggtcattacacaggggacaatgggaaagtttatatggtagtggattaggattaggaaaaagtgggtaatgggaatggaagggagaggagagagtaaaggaggtgatggatcagagacattggagccaatagaggaaatgatggaaccagtggtgtcatagagatgatggagatgagagaaccgatggagaagccaatggagaagccagtgatggagatagggaaccagcagcgttgtcagttgaggtgacagaaccatgtagtacccaatggaggtgatggagccaatgatatagtcaatggtgatgacagagccatgaaagagccagtgtcagagatgatgaagttggtggagaaatgaagccaatgaagtcatcagaaaagatggagccaaagcaggagccagtgaacatgacggagccaatggatgggggatgtagaggcaatgaaagagataacagaaataacaggagaggcatttcaggagatggtggagccagtagataggttacaaaatggaatgagaaagccagtagagggggacttttgctgaacccaacagggactcagaagagatagagctagaatgaggactgagtctccaggagtagggaggatgtgcgtgggagccacccacccacgtgaaagggaaccccgggatagaggtgagggaaggtgtatagggcgagagtggattagtggaaaggccagttctcacattgacttcagtgacggcaatatccactatgctgcccaccacaataagagcgtcaaacgtgttccaggcatcagtgaagtaatgctgcaagtaggagaaaagcagtgccctgtcttctcaaagctcgcaagccagggtagggggccagtagtagtagggggcgccggaggggggcagggcttcgcttggatcacacgatgggcctgcacctgagtccctctcactccctagactcacactccctggctgctgcccgcatcgccaaccccagagctctgca

SEQ ID NO: 137263 - DNA, 1059 bp, Homo sapiens
tgaggtcaggagttcgagaccagcctggccaacatggtgaaaccctgtctctttcaaaaataacaaaaattagccgagtgtggtggcgcatgcctgtaaatcccagctacttgggaggctgaggcaggagaatctcttggacccaggaggcagaggttgcagtgagccgagatggcacaactgcactccagcctgggcgacagagtgagactctatctcaaaataaaacaacaacaacaaaaaaacagatatgcacacatagacaggtagtggtgggagtgggaggtgtagacagtgcccaggcatctaactcaccaggccttcattctcctgtgggagatccttctcattgctcttctccctgtgcgaggaaataggggtgattgctgcagatgggctaagggggatcactacagtcagaacagacctttcttgggtcccatagaactttcttgcttccgctcttccccactgcccctcccaacagtccgttctcaaagcagccagagggagcctgttaaaccctgtctgggatatcccaactctgcccacaaccctcccatgtctccttaattcaggaaaaactacagtcctcaccctggcccagaatgccctcaatctggccctccatttcctccactgaccttcactccataccactctcctccttcctcactccattccagcctcactgtttttatttttttgagacggagtctcactctattgctcaggctagagggcagtggtgcgatattggctcactgcaacctccgcctcctgggttcaagcgagcttgtccagctaattttcttttgtatttttagtagagacagggtttcaccatattggccaggctggcctcgaactcctaagctcaggtgatccaccctcctcggcctcccaaagtgctgggattacaggcgtgagccactgctcccgggcatcgctggtattttttgaaagtgctaagaatgtggtcaggtgcggtggctcacgcctgtaatctcagcactttgggaggctgaggcgggtggatcacctgaggttaggagttca

SEQ ID NO: 137264 - DNA, 3755 bp, Homo sapiens
gtctcgctctgtcacccaggctggagtacagtggtacgatctcagctcactgcaacctctgcctcctgggttcaagtgattctcctgcctcagcctcccacatagctaggactacaggcatgcaccaccacgcccagctaatttttgtatttttagtagagacagggtttcaccatgttggccaggatggtctcgatctcttgacctcatgatccatctgcctcggcctcccaaagtgttgtgattacaggcgtgagccaccacgcctggctgtctgtttttgtttttatatctgtagtaattttcaaacataaatgtagagagaatattctagtgaatcctatgtaccattttgccaacttttcttcatcttttctctcccaactttttctttgttgctgtattattttaaagcaaatctcagacatcatgtcatttcagctctaaatacttaggactacatctcttaactcataaggacattcagttttcaaggtaaccactggaccattttcatggctaatgaagttaacaataatatcttgtgggtttttttttgttttgttttgttttgttttttgtttttttttgttttgtttttgagacggagtctctctctgttgcccaggctggagtgcaatggcgtgatgtcgcttcactgcaacctccacttcctgggttcaagccattctcctgcctcagcccccaagtagctggaattacaggagcacactaagttttgtatttttagtagagtcggggttttaccatgttggccaggctggtcttgatctcctgacctcaggtgatctacctaccttggcctttcaaagggctaggattataggcatgagccactgtacccggccaacaatgatatcttaataccatccaatacttgagttcataatcagattttcccattatcttgaaactctgttgtccctctcttgcctctctctctctgcctctttctgtgcttggtacctttgattccctgtctctgccctgtcccccgatatcctgtctatgcttctcttggatttgggggctctaggcccacccccctctcttcccacatccttctccagcatggggatctagtgggtggagagaagtatgtctgtgagcaagaggagacccctgtcctcgaggagatcccaggctggtggagcaggagagtagagcagggcctgccttagtgggaaggctggagggtgggggtgacttgtctgtatactcttgtcagggggtccttggaggaggcagggccttgggtgctaggtgggcccctacaccttcctgcttcccccgccttttctccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtgagcagagtggtttggaggggggtgtcccaggcccttgcttgtctactgggcctgacaccccaaccctgactggcctgggcctcccaggtcacgtgggcagctcaggaacaggagctcgagtcccttcgggagcagctggaaggagtgaaccgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggt

SEQ ID NO: 137265 - DNA, 1080 bp, Homo sapiens
actgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctggtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaagctgaggcatggatcagggctcagggaatgggagtgaggtgagtggcaggggagacacggggtatttttggcaaggcagtgtgtgtggctgtgtgtgtctgcacgggactcaagagacccactggggggctgtgcgtgtgcatatgcgtgagatacacaggtgaattctaacaggccgtgtgtgtgagcgagcacgtgttgggac

SEQ ID NO: 137266 - DNA, 1031 bp, Homo sapiens
caggtctgggcatgtttggagctggggacaggggcccctagctctcaggacctgaatgtgaggttaggttccctgcaccgtgcagacctcctccctgccccccagcagtctgagtctgccaccaccagtcctggggtcgctcaccacagatgaagccttggtcagtgccattttcccagccaggtgggcctgcatggcactcagcttctccttctccagcaccagctgtgaaatggcacaaacatgaggcctcagcctggcccttctctgccacatctttgcccaggctacggtcttccctgggagtgcccgctcctcttccttcctttataccagccctcgtcccaggtgaacttggtttctggcacatggtggacagaaggttttgcgcactatccctatcccttaccctccaccgccctggcattacctgctgctccagagactgtaccatctctctctggaggagacattgtgccctgcccttctcatccagaagatggtccgcctggcagtgcctaagtagggagaagattccatgcaggtgaccacgacaggcctggtctggctcaatgctctgaatggggagggcccagaccctctgggagttctctcctctgagccccagctcccctcccctctctacctcagtctccctctcacacccctcgttcccttaacacatgcccctcagcacctactgcatgtcaggcctgaactcaccacttgagcctggccagagtgctggagataatgttggaagtgtggtgagttgagaatgggccagggaggtgagagtgggcaaagcattctgggtggagggacggcctgtgcaaaggcctggctgcaaggaggacaggacatgtggggttgctgctaagggttgtgtgtagtgtggtgtgtatttgtgtgtgtgtgtgtgtgagagagagagaaagagagagagagagagagagagagagagagagagagagagagagagagagacatatggggggactgaggggaggcagcagcagccatctagagga

SEQ ID NO: 137267 - DNA, 1082 bp, Homo sapiens
caggggtccgggcgtgggcatccaccgttgagagctggggggcacatgtgggctgtggttcagcctgactcggggcccctccccacagttctcccacctgctccctcctccctgcccattcaccgtccatacctggtgcatgaaatgtggcctgtcctggaggagtgcctgtaagtggggcaaggggcccagccgtgccccggagggtgccaccatgactaggggcagtgtgggcagctgggcagaaaggcaggtgggtgagaggccatcctgatcctcactgttctgtgtctaattcaaatactctgcactgcaagcccacatggtagatgctatgatcatcccccttttacacgtatggaaactgaggctcatggagatcgagtaactttttaaagatcaaacagctaataagttgcagagctggcctcagccctgtcacctcacctacttggccccagtcctcttctcttgtcacatggggatggggacacatagctatgctcatgggactacaatacggcctcctcctctcctgagacagggattgggaggtcggggagagcctccaatctctgaggcctggcaggtggggattttcttggccctgcaacatctgcataagtcacagacttgcctgggacccagaaaccacttcctgtgccccagccagcccccctcccgcccagtgccacagtaaaggtcggcacctgtaggtccaggtaccccaccctgcctgccccatcctgggcccagggcctcacctgcagctgcgatggtggcatggggttcaaggaagaagaggaggcatgggccccgcctcgaagatctcggccctggaaggttccccctgggccccgggcccccagcaggtctgaggctttgggtgcagccctccagctgggcgaggctcctggggatgggccaagggccaaggaaggggccgagggcttgccaggcctggggttgggcatcgggtccttgtccaagggcaggctgcgtagacaataggggaaaggagtcacacgtgtgctagggcggtatgagatactcgaccacctgagccacgtggacactcctct

SEQ ID NO: 137268 - DNA, 2326 bp, Homo sapiens
tgctggcacagaatgggctggtggcagtggagaaggcgagaagtgggtagattctgagacttaatctgaagctggatcaggagcagtgctagcagcttggatgtagtgggcaagagggagagtcaaagtgacatgggttttagcttgagcagctggaaggaccgagctgacattacctgagatgggggacatggcggggagttggattgggtgcaaaagtgcaggtgtagatagacatgaagagtctggcattaaatatgtgagtggaggagctgagggggcagctgaatacgggggtctggatctcagggcaaggaggcgagtccaggagtgtgatcatgcacggatccagcatggcaagtgacagagaggaggagagatggggtctcttgagctggggcctgtagaagcttctctacccagcccccatcagagttcaccccaatttctggccctcaagcctggctcatgctacaccccctgcctcaaatgcccactccttctcctctttccctgtccaagccacgcaagacctgctcttctattgtcctcaccttgaaagccctccacaatggctccgggccccctgctgagccccagaaccttccactccctgagggaagcactggcttttcaggatcctataatcctggtctgagaggaagccagagctggaagggactgcccagccaaccccattatacagaaggggatgctcagatgccgagttccgtagtcccatagtgacttgagaactccacttctttctttaggaagtgtttccgtgtgcacattttataaactctctggtgtgtgtgtgtgtgtgtctccatctccccgttccacctcacagcactgagttgggcacacagctgctgagagcagcccgggggagtatagaagggttctgggggagcagttgctccttcctttctttgctgtcacctcctgggggtggttgtcagagctgtggtgctgagggagatgagtgtgagaatccaggtattaagttcttagtctcctgggggcttagaacattactgcgtgagaaacaggagtgtgggtctgtggaggctccgaacaagggcctgggagagcactggtgagatgagaaggtgagtgaatgaatgaagccagagatggggtgatgctccttcaagccaagaaataacaaagattgccagcaaccaccagaagctgggggagaggcctggagcagcttctcccttatggcccccagaaggaaccaaccctggcaacaccttgatcttggactctggcctccagaactgtgagatgatcaatttctgttgctgaagccactcagttgtggtactttgttatagcagccagaacaaactaataccgatttcggtgcaaatggatgttttccaccactctggcctggcccatgtggctggcctgtggtcacttctgaagctgcctggacacttggccagagctaagaattctccccaaacacatgtgggatggcctgactcagcaaagcatagatacattctcagacagggacatggagatgatctgtctgggggtagaggacctagagggccgggctgggcagccggcttcctgcactgtctgttgggacgtccctttctgactgggtttctcagaagctgaatgggggatgtttctgggacacagattatgttttcatatcggggtctgcatctgggccctgttgtcacagcccccgacttgcccagatttttccgccattgacgtcatggcggccggatgcgccgggcttcatcgacaccacggaggaagagaagagggcagataccccaccccacaggtttcgttccgagaactggctgccctgtcctgcagcaggcttggcccaggtggggtgacatgggtgctggtggatgtggtaggtgatgtccatctggccactatgacaagcccctagctctgaagacctggcccttcttgggttgtggagaggacccaggtttgaagctctgagagtgccaggcaggctccacagatactgggacccctggggtcttcaaatagtataacaccaggacctcagaatcatagaacagcatttcttagatttaaaggatcctagaatctcaaaaccacagactgtggggtctacggtcccaaagtctcagtatgtgtaggccagtgtccctggtgtccaaactccttggaaccatctgaaagtcaggcagcttgctgcttcatagggcctcttgcctaccaggcctggaaacagagccagcctccctagggcctcagtctccctgtccactctggaacaacgttcccaaatacatggccactccgc

SEQ ID NO: 137269 - DNA, 1178 bp, Homo sapiens
tgctgaggggtaaactgaggccttcagttggggagagagccagaaccagggtcccacctagagtcctgagatctaggcttggatttcaactctgccgctgcatttcggtgaggccctgagatctctggtcttcaatttgcccttctacactgagcacggagaggcgtggagtagacaagggccagggcccttctacgctgtctggttaagtcattaggtgtctgcagggcttcaagttgacaattgcccctctatccaggggactggctgagagatagggatacatagagacaaagagacacacacaaagagcgagcaagagagaacaagagatagtgagagacattgagagaaatggacacatgcatggagagccagagtgcatgtgtgcgagaggaggattgcctcaaataagaacatttgctggtctctggctggttcaactgatgctgcctgaaataatcaagaataaagaagggcaaggtgccagggacacccatggctgggtattgaattgtattgcaaagcaacaatcagcaaaacagtgtggccctggtataagaacagatactggggaagagaacagaatagaaagcttggacatggacccacatatggagagaactgaatttgtgatgaatgtggcatttcaaactggaggaccatggagtatggtttaacaaatgtgtctgagataattagggagaagataaagttattgagtgaatagtcagtccattatcccaacaacccctccctgcccagtttgaaatgtcaccatcatcatataccctaaaatgcccagatccattcaagatataagttttaacacctaatgctgatcttgggtttattgtgtgtcaggccttgtgctaagtatttactgtggttaaaaattttaatctaaacaaagactcctgaggaaggtactattataaccattgcagtacatatgaggaaatggaggtatggagaggttaagtgcctggctaaaaatcacacatagggcttggggtgacgctgggtttgtcccagacagtctggctccagtacccacactcttaacctctatagtaaatggaaaaaatgaagccataaaagagactagaagccaacataggtgaacatttatctcattttcaagtaggaaaggactttctaagcacaaaaccagagac

SEQ ID NO: 137270 - DNA, 1036 bp, Homo sapiens
ccccacctgccttcccagccagcatccagcctagagctttgtacacagctggcgtttaataatagtaatgtcgccgaggacctttacattttatgagagtgagcatcagttctgttcaccctagtagcaggaggattgcaaggtgccggggcaagctgagcacttaactgaactttgcttgtatcgctttagaggagacccttggggcgggggggcagggagcacttcacaccattgtcaaccgtagtttagctgtgtggacctaccccaggactgcatgtgtgtgaccagagtccatattcaggaagcaaacaggttgttcagggctggggtgagctcgattctgcaggcttagcacagcgtttggcacaaagtaagtgctcacgaagtgttagctattagtatttctgtaaccaaattagaatcatgctatatattggttttgttcctgctttattcaattaacagtagtgtttttgaagcttactaaaaattgtttgaacacatgatctttcatgatggacaagactgtcctcacatcagcatgaactttgattgatttgaccaagtgccgattgttggacattccggttgtttctcgtttttttctataaacatccctgactgcttccttggattcctgaaaagggagttgctggggcaaagggggcgtgcatttttaaagtttatgaccctctctgctaattctccttccaaaaggttgtcctattttatgctccctctacttaagctaaccctaggtgagtattattatgttttaattatttcccaacatgacaggtaagaaaaacacattatcacattgttgaaatttgcatcttgtgattacttttactattcattggccattcatgcttttttttttttttttttttggttgtctggtcatgtccttactcctaatagggtgttcatcttatttttcccttattgatttgccacagctctttatttggaatggttattaacctttcatcagccattacatatatagcaaatattttccccaattcat

SEQ ID NO: 137271 - DNA, 1899 bp, Homo sapiens
ccccagccctgaacaacctgtttgcttcctgaatatggactctggtcacacacatgcagtcctggggtaggtccacacagctaaactacggttgacaatggtgtgaagtgctccctgcccccccgccccaagggtctcctctaaagcgatacaagcaaagttcagttaagtgctcagcttgccccggcaccttgcaatcctcctgctactagggtgaacagaactgatgctcactctcataaaatgtaaaggtcctcggcgacattactattattaaacgccagctgtgtacaaagctctaggctggatgctggctgggaaggcaggtgggggaaggcaagaaaagagagcgggagagatggaggaaaggagatcgatggagtgtggtcaagatggaggagacagagataggggagatggtcagaggccaggagagatgcggggaaagagagtctgagtgtagcgacagacagatggcgggagaaagagaggcagagaaacatgtaaaagagcaagacagggtgagcagagagacagagaaggatgagaggcatcaagagctaagagacaaagagatgagagagatgcagttgaaattttcagttgcacctggacagcatttcaagttgttcaaagctctgaaatccataaagactggcagctgacatattttaaaaatcctatccatctacgtatcaattgatgaattcatttatttttgcccctgcccatgcattaagtacttcacctttaagtcttctgccatttattctattattatttttttaaagaccttacctggctggaatcacggtagctgggtacatcccactgtaccagagggcccctgacccccccgccgtgcctacctccctgccatctcctccaatggggcccacatctggtaggggagagcagggacactcaccttggtgaagtggactgacagaaaaggatcagcctggcttgtgggaaactgtcacgtatcaaaaacaactttgcttttataccgagaagaaaaaccacgctgtacggtgtggaagccgcagacctctctcttctaataatccaaatttttttcgatgagtgtgtgcgctgataatcacggggtgggggggggttctcatagttttttttttctctctctctgtgtttctccttttcttgattatgagacttaaacggaaattttgaaattttgggtttttttctttgccctttacgagtcatctgaaaatatgatttcttcccctcaccacagaggtgagaggtatcaatgagataatagggctcatgagaaaccacagtttttaaaacaaaagtgtatagagtttgaaaaaaaaaaaacaagggaaaagaactaaaataaatcacagggccaacccgaggcaggcagagacaccattctgtgagtgagaggatatttgagggtctctggggaaagaaagagaatctgaagctctatgtgtggatgggaaatgccagggaaagagacagaatagggctgggttcccagaggcctcgccctactccaggcctcagtttccctatagatggaattgatatggtccccattgcttgaactacccggcgaggggagttctgcaccccctgcaacacccctcccacagagggtgaggggcatgtaagttacttcatggaggagaaagcggagagcccactgtcatcccctaaaattcatggacttgaagagtcggagaatccctggctcccagaatctactgacagttactgaatgaggaaagagagaaaagtctcgcctcatcacgttttagggcttgagtgccctgacccagccactgtcccactgggaaggtccctagcaggtccccaatattaatgcatccatcctcacgatgaaccccagaggcccattgg

SEQ ID NO: 137272 - DNA, 1104 bp, Homo sapiens
ggggcctctgacaaagacttgaaggagatgagggagggagccagctagatatctgaggaactccaaaggaaacagccagggcaaaggtcctgaggtgggaatgtacctgatttgttcaaggtctacaagggggctggtgtggttagtgtggagagagcaagaagagaagctggaggtgaggtcagaaaggggactcggaggttagaccacgcaggaccttgtaggccatggtaaggactttggcttcaacgctgagtgaggaggaaggcatgacagggttgcaagcagaggagaaacacaaaccgtgttaggatttaacaggaagcccctgaatgctgagtgtacaatggggtctagggcctgaatgtggaagcaggggaccagcaaggagctggctactgcagtagtctaggtgactggtgatagtgctggcagtggaggtggtgagaagaggatggatttggtaaatatttttaatagacagccaaaaggatttgttgaagactgagagtcttggagccagatcgggacagacaatgcccaaaccaggtgggcaggaaggagtccctggactatttgccagcttgaacttttaggtgagaaaaaaataaagttctgtcttgcttaagcccccattattttatgatttttctgttacttgcagctgaacatattcatttctaactcatggacatcctgaacatggagacctggggagaggggctgctggaaggatcacctccctcctaggatgctgtgaggttctaatgagataacagcatgctcagaacctggcactcagtaggtgttcagtaaatcttcccaggatggagaaggaatgtatgaatggatgtgttcagcggacaaaagctgcagttgagttcccacagaaggtgagaccccaaagggagagcgaaaggagtttactagatggaagcagcagaaggaacagcactcttgggagagggaacagtagaagcagagatggggggacagaaagaagggaggtgaggcccctgtggggtgtggagtgtcaggttgggcaagaaggacagggctttgattgtgattccattagtcagaagctacccatatgcccaatca

SEQ ID NO: 137273 - DNA, 1553 bp, Homo sapiens
ccgggcccgccccacggccggtagcggcgcaactgcgccagcggcagccccaaggcctcgtcggcgaacagcaccctccgcggggccaccgccgcctcgaccgaggtgcggggctcacccgcggccggcgaggggggcgcggaatgccgcagcgggggctccacaggggccgtacgcgccatatcggcggcggcggcggcaccgacggcaccggcggcgggaccggcgggggcagggcctgaaggggcgggcagccaatgggaaggccagcgcggaggggtacggctcacgggggcataggcggtgagatgaagacaagtattgcagagggccaatgggcagccatgcacggatgacgtacagcgaattgagagccggagaagcacgcagccaatggggatgcccgggagtgggcggtgtagggggcgggatgatcgaggaatcaatggagaggccggaatgggggtggtgcgaaatccatgatgaagaaaacagaagcagacagctaatgcggaagtctgagcgagagaggcatgtgggcggtgggaaaagtggaatggctacaggcgatgagggcagccgggaacgaacgcagaggcccaaaaagtgggagatcccgcgggttgcgtaggcggtggaacggtagctagagagagagaacagccaatggagagccacgcgtgggatgacgacaatggctgcagcgagccaatggggaggcttgtgagcgtgcactgcggcttcgaaggggtggtgccaaggtggagctagccaatacgaaggctaaaaggagaccaagaggcgggtgtgtagggagccgagccaatggaggtggaggctgaaggcgggagcgaggacgagagctggcggatagccaatgagggagccagggtgaaggcgtagagacctcaaaggacagtactagtatgggatgagccaatgccgaggctagatagtgcagcgggacggagggaggacttggaggcaagatggggaaaaaagcagagccgacgggggcagtgtaggtggtgtgaagggaggcatgagtagccaataaggaggctggagaggaggacgctgtgtagacagagtctgaggtattgggtggccggacagcagaaccatagaacgcaggcagccattaggaaaaatgtgcttctcagggatggggttaccctctccctaaccctccgtgactccccattgccccaggaatacccagagcccctgaaggcctagaccacaccttggtgtgtgaactaggaaagtgaaaatgactgtcctgttgcagttagttacttactgggtcctccctgcccaactacaaccttttcttgagcagtgccacaagccaagaatgcccctgattgttagccgcaagcactctccaggacttgatactattgttgaatgaatggccgaataggaaatttaactttctgaaggattcacttttttaaatttcagctcagcaaacactgacctgactgtgtgctaccagaagttgattgggcatatgggtagcttctgactaatggaatcacaatcaaagc

SEQ ID NO: 137274 - DNA, 4585 bp, Homo sapiens
gccacagcccgagtgccagggtcccgtggaggctgaggccaggcagctgaagagctgcatgaagccggtgaggcgcaggtaatgtcagccagcgccacctccgccaacgcagggctgtgtctgggatggaggacaagcattccggcccaggaacccctcaggcctgctctccaggacagggaggagggtgcattgagtcagtcagtcaaagagtgatggaggtcaaacacgtgctaggcactgttttaactggggttttattcctccatttattgagttccactgtaaagccctgaacaagacagacatctaccctaccctcaaggattcatacaggctcctatgggagacagtttgaaaaaacaagcaagcaagcagataggataaatagggacaaagttagctgctgaagggagtaaggggatagattgggagggaatgactgtgtcagacatgctgttaaagggagggcctttgaggaggtgagtcccgaatgatgataaagaagagttatgcagatacggtggggaggtgggggagagtttgtaggaaaaggaacagggaggacttttctgaggaggtttcatttaaactaagtcctggatgatgaataacagttatgtgcatatatggaacaagggtgttctaggtagaggaaacagcaagtgcaaagtcctggggtggaaatgagcttggtgtgaatgatcagcagtgtgctggagtggagagaactgcaatgacatagtgtggaccaagggctttgccagtggggggtagagcagattctctttctgacagagcaggaaaccaggattccagaggtggagaaactggttgaggcagtgatggcacctggctcttccagttcacccatgcctgaccttgaagcctgtgcactctactgttaacgctgtaatctacttttgagtcctgtggaggcgaggggctgagcccatgctctcacaagaaagcagtggctctagcagagagacagaaccagatgggtactggacttgaagtttttgtcccttgtttttttgccacaccacctgtgatcatttagggacagggagaaataatcagttataccccagggggccccagaagatttccctaggtttcctctatcaagctatgagttctttaagggcagcagctagtcctgattctttttgcggtcacctaagtctggcccaggatcactagattctccctaaaatgtatacatttccctgttcctgggaggactgggaatggaaatgggaaaatgctttttggaccttgtatgtatacgcttggtcagaagcccctggctgcagtaagacatttgtgggttctgctggttctggtaaggccttaggctgtgagtggttcagaaaggtctagctccggtctggtgggcagatgtgcctgggtaactgagcaggcaggcaggtacccactcacccacctgtgagccccaccataatctgagacttcatttaaagggggcaggcagcatggtttttcttacagcattaagagtgtggattctggcatagattgcctgggttcaaatcctggcgctgccacttactggccttgtgaccttggccaacgcatttaactacaccatgcctcaggaccctcacctgtaaaacagaattatagcatctactttacgggataagagtaaaggtgctcagaaccgagtctggctcaaagtagtatcatacaggtgttagctagtgtcagtatttagggagccacacctacagtttcctggattcctctcctaaattcggctccgcccatcagctgtgtggccttgcctccgtttccttctctgctaagggaaatgacagtcactttgcatggttggattgaatgcagcaaacatgggcaaggtaactgaagcatggtggtaactgcaaaagataactggccagcatttactgatttctgtgctatgaacatcagatccattctctccgtgaggcctgctgtgcatgctgtgttgtgtaggtgctatgattatccccatttagtagaggggagacaggtagctcagagagatgagccagcttgctcaaagcctctcagctagtgagtgacagggccagggaagaaatgctagggacatttatttttttctatttttttttttttaaactggtcctctagaaagcgtggcatgattcagggcaaattctggatttcactcttggtgttcccagcatgtcgtgctttccttttacctttttttttttttttgctttatcgaggtatacctacataaagtgtactgatattctgtgtatagcccagtggatttgtacatatgtatgcacttgtgtagccaccacccagatgaagatactgagcaggtccagtaccccagagctaccttcatttctatcactttcccaagctgtcatccccgccggctgtcatgggaaccctgtctgtaagatgcgacagtttgggtaaaggagtttggtcattttaaagagtgtgaaaggcagagaacagagaaatcaaaaccttgcagggccaaggtgggtggagagggtgtttttcttttaacatacatgggcggttttaaggagaaattgaagcagcctgttcagacaattgttttggtatctggccccaggtctgtggttcctaacatgacttgtgatattattttaagtgggcagatggctttttgatagcttctttatctttcgatctcagctcttgcaaaggggaggttggtgctcattgcaagatcagcgataagggtttctttgtaggtcggtggctttcttggtgagtacatttcaacatattattgttttagaacctgtgtgctgccagtgacttgcagcactgttgaagactagccaccctttgtgacctagccctcttgggaaatggcggaggatctcagggtatatcccttacctgtgggagccctatcagagggcttcctgttgaggaaatgttggctgtaggccctctgtgcactgagcacagccacatcaggtgagggcatgggagaagtccgtggtagccatcaggatagagttcagaaacccaaatggctgctttccctgggttgctggaccaggcatttggtaactctaaagcttagagatgattcatcgacaagcatttattgactgcctactgtgtgctgggcacagtgctaggttccagcagggaaagagatgcagagtggtcctaagatgtcacagggcttgtgggatggagtacagaggatttgttgtatgagacctggctgagcccctgctcttcgccaggcacttcactgagtactatattttcatgcaaggtctggtttaattccgacaacattccctgtgaagtagagggttttaaatttctctttcctggatgagcaaactgaggctcccagagtccaaagtcctagggctggtgtggggaaaagccctcctgatcttccttggcacttgacactaccctttggaagtgtcctattcttcttaaaagtaaagaccaagagagcctcaccatggtcttcaagcaccctcccatcccattccccaatctggcctccactggctcatagtcttaacaccagtggtctttctgagctcctgtcaccatggtctttctgttactccaaagggcctcgctcctttctgctgcagggcctttgcccctgctgtttccttcaccaggaacatttatcccgtaccccttgcagtctcctccagtgttgatccctcagttctaagaggacttccccaggggagcctgtccaccccagtgtcctcgggcccctggctttttcatagcactcatcagcccagcacgtgctaagctttgttagagaatgtcccatggcagagcagatgaacatcgccaccagtcgaggggtcatcggccaccctgcctagcagttctactatatttttttgatccactcgtttctcctctgaagtgactctttcaaatgttctttaccttcagactttctctcctgcttcaaaaaacaaaacagaagccataagaatggaactccctataacttgtggcccccaagtctgcacgctgatttccctcccctgtgttacagatgacgaggagtcccttcttgctcaggccacttctccctcctgtgctctgggtcccagtttctgctacttgctctagaatctgacatcatcagtcaccttttctctcctggcaggttttctgctgccctccttgcttgatcctctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaactctctggcccttctctttctcctggctcttcccttagcttcatgtatccaaactcggcatctccac

SEQ ID NO: 137275 - DNA, 2075 bp, Homo sapiens
ccacatgcagtaaaggtaagtattgtttcactcgaagaacaaccatttttcagttatttatatgtctgtttacacgtgtgggtgtgctgggttatgatgtagaatggatttcttactatgggtcgtggccaaagaatgaagtcatggctgttgaagaagctcatggcacgagaaactgctctccctctaccccactggatcacccgcaagtcccagagttgaggctgacacacttgttggggaaggcaaagcagtgccccacataacttggtggctttcacagccaccttcaaaccctgttcttttcagaaagcagatggctcagggtaactgcaattctgagtatcgtggggcaggtttctgaagccactcatccccccggaaagtcagcgttatcttcaggttgactacatgggagccggggtctgctgagtttccctttgggtttcagtgcctgacccactttgggctggcaaaattctttgaaaacatgaatgctgggggtgctccagaggactcgggtggtggtggcaatggcagtctgtgactgctctgaaagtctgctttgcttttctccacagggcttgtcagccctcacccgctcgcttactctgtgactggcgaatcacctttcttggctttcttggctggcctaggccggggccaacaccacctctttccaaatcctcaccctctggtctcctcggggcctatcagcttggcagccattgtgtttcctgatggccggaggaatttgcacgcccaggagactggcgtgcaggcctgagatggccccttttagtcgacaccagcttgactagtgctcactagcacccaaatgatgcatgtccaagattttccagatctgtgtgccctggcccctatggctcactgcccttgaggggatgccacgtggtacttgtggggctggtgccaaaagaacaggtttccttcttgaaaacgagcaggcatactgcaggtacagttttgttcttaatcttctccctccccatttttctaagaacccctcttctctgttaccgatcagtgagtcagtatacatttgtacttgatttctcttactatcctcatgttgattgaagtcatagctgcccttgagtttttactgtgaaagacggttcaaagataacttgtttctttttaagcccacaatttcaaactctcttcaaagtggagccctcctggagtgtttgttaccagcgtggttgtgtagtcagtgagtgtagagatgcagttccttgagttttagtttttgcatttgtaaaaaggaagggtgttgttttgaaggatagatgtgaaggttttcaaatgccttggtgtgtcaatgagaggggcccatggtggaggaggtgaacaatacatgcttgtgctttctgctttcatatctgactttggagaacgacttgtttgcttctgtcgatgttgtggatcttgggattggctcaatggcgtgacctgctttttggatgttctcgccctcctcagccatggaaagggtgctctgggggctgaaggattgattgtgtatttgtttttctttctccttcctccaactgaattgtggagtcctttacctgctggctagctgattcctgagtgttctcctttttctgtctcacatctatgactgcagtggcttttagaagcctgtttgtaatatatgtccggactaggccagatggaggagaaggcttgcctgctactgcgcacaggtgggagggctggctttctgtctgtctgtgggccttcttgaagaggcttggtttagaagatcctaggaggaggatgttttctgtcatgaaggactatggtaacaaaaagaagtaagttagtgcagcctggcagaaattgtgttgaaacaaaagtccaaagacctggattttaggaccacggaggggattggtgtgagaccaagctggtttgctctgaatctctctttctcatctgtgatgtgtgggaggtggcagctgggctcccagagtcacccaccctaggccctgtagtattctgattcaagtacctctggtgggatttgtgagtcctagacagtagag

SEQ ID NO: 137276 - DNA, 1517 bp, Homo sapiens
ctgagaccaccaaagtgacaggcagtctggaaaccaagtacagatggactgagtatggcctgacgtttacggagaaatggaacaccgacaatacactaggcaccgagattacagtggaagatcagcttgcatgtggactgaagctgaccttcgattcatccttctcacctaacactgggggggaaaaatgctaaaatcaagacagggtacaagcaggagcacattaacttggactgcgacatagattttgacattgctgggccttccatccggggtgctctggtgctgggttacaagggctggctggccggctaccagatgaattttgagactgcaaagtccagagtgacccagagcaactttgcagttggctacgagactgatgaattctggcttcacactaatgtgaatgacgggacagagtttggcagcctcatttaccagaaagtgaacaagaagttggagaccgctgtcaatcttgcctggacagcaggaaacagtaacacgcgctttggaatagcagccaagtatcagattgaccctgacgcctgcttctcagctaaagtgaacaactccagcctgataggtttaggatacactcagactctaaagccaggtatcaaactgacactgtcagctcttctggatgggaagaacgtcaatgctggtggccacaagcttggtctaggactggaatttcaagcataaatgaatactgtacaattgtttaattttaaactattttgcagcatagctactttcagaatttagtgtatcttttaatgttgtatgtcttggatgcaagtattgctaaatatgttagccctccaggttaaagttgattcagctttaagatgttacccttccggaggtacagaagaaacccatttccaaaaaaagtcctttcagtggtagactcggggggaacttggtggccactttgagatgccaggtttcttttttatctagaaatggctgcaagtggaagctgataatatgtaggcactttgtaaattcatattgagtaaatgaatgaaattttgatttcctgagaattgaaccttggtttcctaaccctaattgaggagaggctcgcttcttgatgttgtgtacaaactcacctgaatgggacttttttagacagatctccatgacctgttcccaccccagttcatcatcacctcttttacaccaaaaggtctgcagggtggggtcactgtttcttttgtgccattttggggtggagaaggtggatgtgatgaagccaataattcaggacttattccttcttgtgttgtgtttgttttttttttttgcccttgcaccagagtatgaaatagattccaggagctccatctataagcatggaagtgtctgtgtgattgtaatcatatggttacaacactcagaatctaaattggacttctgttgtgttctcaccactcgatttgttttttagcagtttaatgggtacattttagagtcttccattttgtgtggaattagatcctcccctt

SEQ ID NO: 137277 - DNA, 1048 bp, Homo sapiens
cagaaaggaccttacctgtcctctcactccttcacagcatcctagagaaacttgatcctatgcagagaacacagcagctgccaaccgacaggcaccaaggtcagggaggcagcaggctgcagatagcctttccaagtgataataggaaacacctgagagctaatgaaagcactttacctgaggagaaacaggaggctgagactagagcccacagtttatactgattgcagagtgtgagatctcagtctctcaataaatctttatttaatctacataaagatctgagtagtaggagcagctcctgcttagatataaaaagtggttatccctgattggtgatatcaaggaagaattatatattcttcacacttggctctgtattgactctacatcttatctgtaggagagagggagagaaggagagggagatctggcaattctacttctgccatgggggatctttctaactctcaaagaatgtgcgcttctttaagggtaacctgcagagtctgagaacggtccaggtccaggcatgcacggacagaaaggatatttttcccccaggggtttagcgggggcaggaggggttggacagggatgtgcagggcaagctcctttctgtcttgcaggcacccatctaacttttgcccaaagcagtaacagtgggcttctgtccccctacccccaaccccccacaccttctctgacagcagaggatcagaccacctaggtgatggtgaagctctttgacgtgcaccaggtgcaggagacctatgacccctagcactgccttttatctgctgggttccccttggagaaccatatatctttggagccccagaacatgctggttgcacaagaacaaagcacacttactgtctgagaggaaggctggtggtgtggtagcactattgaacctctcttttcttttgagatcatattgtacatacacagtgctacataactggatgtttcaagttaataacttaaaatgaacagcaccactattacaggaaatattattcagcactggttttggtagtcaccc

SEQ ID NO: 137278 - DNA, 1054 bp, Homo sapiens
accagggtcagggaccagaatacaccagagctgagggccagccctacctgagaaccatcaacaaacttaccccacatcccattatacctcctcactccctgcagcctgtcagcttccccaatctcccacactcactgtcacctggggctctggtgcaccagatgacactacttgctccctggtacacaggtgagtgcagccagtgtcatacccaaggcctctaaatgaggtccacaggcaagagccatcccagcccacatctgatatccaagatgcaatgctaagtggaaaaagcactgtagaacagtgtgtggaatatggtcttgtttatgtgtgtgtgtaagatataggtataaaatatacttcaatattcatagaaaatttatggaagaatacacaaaaattgttaacaatggttattactagttctacagggatgataaacagggaggggtgaggactgtatctttactaattatcatcatttgaatatttttgccatgaacatgtgttacttttataatgtaaaagcacttaaaatcaaaagatgtagatagtaaattaatatgtagatatagatagatgatagatggacaatagcggtagataaatgatatgaaaatagctaaaagctaaaccagacagatatatctgtgcattggtttcctcacgtgaaatggtacctatttcataggattattgtgaggattaaatgacttcatacgttcgagtccttggaacagtgcctggcacacagtaagtgctcaataaatgttttctttcggataatactggtgtggagatggtggaggaagacaggctggctcgatgtgataatctctttcgccatcttgtggtcagtggggcacaggccacacagcaacattaatgccaattagcagcatgggttcactttgcacgttttcaatcctcttcataggtaagtgtaggagttcaggccttagggatggaggacctaggacttttaaaatcgaaaaagagcttaaagaaataaacaaataactttacaaatgggtagccagaataggactta

SEQ ID NO: 137279 - DNA, 1042 bp, Homo sapiens
taaattacctgtcgttgcctgttttcatttcaaacggtttgaacattcagcgaaacagaggcgcaagatcactacatacatttcctttcctctggagctggatatgacgccgtttatggcctcaagtaaagagagcagaatgaatggacaattgcagctgccaaccaatagtggaaacaacgaaaataagtattccttgtttgctgtggttaatcaccaaggaaccttggagagtggccactataccagcttcatccggcaccacaaggaccagtggttcaagtgtgatgatgccgtcatcactaaggccagtattaaggacgtactggacagtgaagggtatttactgttctatcacaaacaggtgctagaacatgagtcagaaaaagtgaaagaaatgaacacacaagcctactgaagtgacacacagacctacctgcaatggaagatgacgacaccaatactacaactggcatcgagatctaaaggacctacttgaccatggcccatgggcctgacagagtaagaattgaacagtacccagtgtccaaaaggtcctgattggaagagaaatagaaggggagggagaagaggctctagtctaagcagttgatgaaagggaaattaaatggtagaaacactctgggtgaggaaggcaggagcaggaaaatgctgacactggtacatatcctatattcctccaaaagattgtgtgggaaagtgtgggggggaggggggtggtggggggggagtgtgcccttgtaaccgtaaaacatctttctccatgggtgtttcagcttcaattgaccaatcacataacagttatatgtttggggggaaaaagaaaagtttctaaaaaatgtagcccattacatatatgggtatgaaagcagaaaagtggaggaggcagggatatcattgacaaacacctttgccagtttctttgtattcgtgattttttgtgctattaaatgcagtattaaaacaagaaaagcccacctgggctagtgaaaggagaggaaataagggggcttgtaaaagg

SEQ ID NO: 137280 - DNA, 1048 bp, Homo sapiens
cataagaagcagctcaaattatgtgatctaatgttattagtattagatttctactactaattactctgtgggccgaaagctcaggatagacagtttcattctaaggacaaaccttctccccagcaaaaaaaggcactgcaagctggaaatagtgaaacacaatggggcattgcgttttcaaaggcaactgacacgcccagcactgggataggacccgcccgcccagtcctcattaaatatggcagcgagcggggccgacgtactgcggctgcgcaagttgaaactcctcctggcagctcctccccggcgggcctcccctcatctcggctgggtagaggtgccgggtgtgagctcggcgtggcgcgcacgcgcagacgctggctgggctgagccgatactcgcgaggcgccctgtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacaggtaaaggcaaacgggctgtcccttccccaacagtccttggcgggccgctggcccccggcccacccccggagcaccccctaagcgcagcgacacaggggaagcgcaatcccgctggcttggacccccggagatggggcttccccgcgcccggcgttggcagcccggcgcttagaggaggtagacaggctagttccagccagtgctgagcggcgttttcccgggagcccagccctgttctccgagttatggtccctgggttgcccgagcgaagtttccttgcggagcggcgccaagcccgccccgcttttgaatcggagtgtttagccgcctgcgtcccctttcccggactggggtagggtgacttaggctggcaaagctcagccgaggcccggctcttctccctccggctctggacttgccgctggttttgtatgggtcttagcaaagtggagaaactc

SEQ ID NO: 137281 - DNA, 1056 bp, Homo sapiens
attttgagcggagttgcggtttgtgccctttggagggtttaggagtctccacgggtatgtgggatttttattgttatcaaaagtgagtgtgggtttaagaaatgatagacaaacactaccaaaattggcctgtgacccacaaaaagttaaagaccacttaaatggagtggaatgaaatagcttgaatatctagaaatattcagcaggttggttagttggtggtctaatgtatcttttaaaaatgtttcattgtgttggttgtgactttatgtaggcacacaaatgtaacaagtagtttccatgtataaagattatcaatgagaagacatttatggaaacgggatttggcctgtatgcttcctttgactcacacaatgggcatttatcaagagcagtttggatattcttgcttaaatcctgagacattatttcattcaacaaacgaaatacagagatgaataagttgcaggatgctagaagattccttgtcatctaaagacagacatacaaacaaataattttgccatgttgaataagtgttagaatagagaggtacaaaaagcaagggaagccccgagaaaagcttgatgaagtctgagttttgagctggtctaaaaaaatgagtaggagcaaatgagagaattgcattctgggcagacagagcagcactgtttgggaagttccaagttgctctgtttgcctcatgtgagatgtgtaggggcgcgacctcagatgaagcagggaaggtagttggaggccagataataaagagccttgtatgttctaggaaggattttacactttatcctgaagacaaagattctaaacagggaagtaacataatcagattttgttttagaaagattactttggcagcagtgctgagctggaaatgatgaaaactgggagtcagtcaggaggtttctggaatagtttaggggagagatggtaagggtctgagcagaagcaggggcagtaaggttagaatgggattctagaatgttctgtgactggatgtggcaagaaatgggcctggattaactaccagcttgggtg

SEQ ID NO: 137282 - DNA, 1048 bp, Homo sapiens
gatcacgaggtcaggagatcgagaccatcctggctaacacggtgaaaccccgcctctactaaatatacaaaaagttagtcgggcatggtggcgggtgcctgtagtcccagctactcgggaggctgaggcaggagaatggcgtgaacccaggaggcggagcttgcagtgagccgagatcgtgccactgccctccagcctgggcgacagagccagactccatctcaaaaaacaacaacaaacatctagctcaattcctagaggttaagtgatatgcccaacgtcaaacaggtagtagttgatcctagagctagtattaaaatccaggtcacctaattccctattccagtattctttccgtgggctcatggaagaggcaatgtgtgagtctgttctcagctcaaggaagcttctgagtcagtctgtagagcttgttgaggaaccctaagggctacaggagcccaaatctccttaggttcttggctcattgctgtctggttcctccatggagaatttgatctgaattcccatacctcttaaatggggccaacattattttgacttcacttaatggagccctctaatatattttctggccactttaaacagtgtactgagcataatttaatatttttgataactcagggttatcattaataacctccagccagtttgaggttggagacttgtgttgtcaggtgttgtttatttattccattaacatttattgaacactacttgtgcagcaggcactctgctgggccctaaagacgcaatggtcagtggaaacaagtatggtctctactgtaatggaacttaagaaccaggataaaggtagcacttcaaattaatgaaatgatttatttaacacatatgctgaagtaatttggaaaaaatgacagcataaatttagaagggttaatataatgtttcttaataaaggaggggacatcagaattacctgtagtgctttaaaaaatattcctactcaggtccccattcccccaaattgtgattcagtcttaagacctgagcattacaatcctgtttt

SEQ ID NO: 137283 - DNA, 1048 bp, Homo sapiens
ggaagaaactgaggcccagtgagacttattttaggccacacagctgtcacatcgtacccaaagccaggactagaccctggggctcctgataatcagtgctgcccagcccgctctttctctgtcaatctgtctacctatttggtcctactgcattgcactgccttccccaggcttgggtatcttacagttttctgttgaatcttagtcttttcctactatgctttactgctaccgtgaaacgtttagttttttttctcccctcaaaaataggttttccattgaggcttccaggatgttttttttccccttcttctcactatgttagcttatgaaataaactataaattcttattatttaaccagaattatgattcagcttcctgtttcatgtaatgctgttctgtgtgtcaagggttgggggaggcaggactagaaagtttcattattggtggctacgaatgccagattctccttcttcttttccttcctaccttctcttaactacccagtatttatagacccatggtcaggccaaagaagctgttgaggagttaatagtatgaagtgtctcccttagtaatgtcatattttgatgattttcaacccaataccattctggcattaggtggcaatttattatatttatttaggatttctgccctgactacatccaggaggaacatagaacaacacagaaattaaaacatagagcaattagaaataaatgcaggacagggaccatccagtggaaatgaaatcgatattactaggcatgtgagatactagacactgaagttttctctttcttttcttctgtgtccctccttcccaaagacaagcacgataagttacatcgttgacatcttctggccaaaaaacgtgttcagatgcaaaagaaaaccctggctctgtctatgctaaatcttctggcccttccactgccctccctttggtctggccttacctgtggccacctgtgactcagcactgaatattcccaggttgaaatcatgatctttcctgtttagctttgagaatggtgagagac

SEQ ID NO: 137284 - DNA, 1246 bp, Homo sapiens
tcaaggggaacttaccgccagaacatttaaagagcgacagacaaaaatgttgagacttgataaattttatgttgagttattgcatattaatacttagtcctaaatactgtacgtgaatgtatcttaaactgtgatatagctcaggggtgtaaatgagttgccttaggtaatgtagtgatttattcatagacccaaggccagaaatcagattccttgattcccagaccattattccttcaatttggctatggcttctgtataacatcttttctgctttgagtctcctgaagagcagaatcaagtatgtcaaaaattgaatgatcttaggtgctggatgttttgcacatttatgcaagaatattcaatgttaccagtcatcttaaaaaagcaacaaaataacccaaaataatgctgagtaaaacacaagaagttatgttactttttcacttggtgacatggatgaaatattacagcaaatggggacagagcttaaaggaagtggtagggtgaaaggaccgttagtataacacagctggatggcatttctctaagctaccattttgaagaatgttgctctttggactgactcccaaactccatctggctagcactttggaattttaaatgggtaaaaaatatgattttccattgctcccagctgccctgcatggtttaatagacaactatgtaaaagacagggagtagaaccagcatttgatttgctttatgaaattgggaaatacacttggttttttaagctcaagttttttcataggtagatgatatggtggaggattatggtagttaatatttattgaatccttacaatttatcaggtactaagcccttccacatattattaaacctcaatatagttctataaggtaaataccatattaccccccttttaaagttgagaaactgaggcaaagagaaattaagtaactagctttcacagctaataagtagttcctggtatgaattgagatatactgtaagtgtaaaatacacaccagatttcaaagacagcatgataaaaaaatgtagaatatctcaacaatgttctgtattgattacatgttaaaatgataatattttgctttttttaattcttagtttttgtgggtacatagtgtatatatttatatacacttgaaatattttgatacatgaaatattttggtacatgaaatattttgatacaggcatgtaatgcatagtaatcacatcatggagaatggggtat

SEQ ID NO: 137285 - DNA, 1045 bp, Homo sapiens
ccaaagacagttcaacctagcaactattaaactgactttcaacatggcacgattctttctttttttaatatttaatgaaggaaagccctactgctctatttccccagaggtagaaatctcaatttatgttgtttgagctgggagaacttgttaattaaaactgtcgaactgtagtgaattttgctattttaatatatgtttcatcagttgatgggggcaggggttggaatagtaaagagtacacagatacttttgtgatttggttatgatgagactgatcttctaatggatcttcaaattgacaaattctgggaaagccaaaaaccaatcccaatctgtatagaactgtaccactattccaaaggtctgtcttaattctttgagcctgattctcttgccttcactctgctttaggaccagtctgctttaggacattagagctaatattagccttagactggagccatgccacttccagaagggttccacactgggttttgaatccaaacaggcctaatcttccaagattcttaaaatcctattgtcttacctttgatctagtgcagcctctgactaaggctggcatgccactcaccctgcagtggccttagcaggtgattgttccagctaccccacaagcagtgactctggagtgggtctgcctggatttgaattctagctctgacacttgactagctgtggttatagccacattttactcctctgtgcttagttttatcatctgtaagatggggatagtagtatctgcctcacaggagtgttgggatcattaaatcagctaataaatgtatagtactaatgtctactagcctattgttgttgcttttgctgttgttattccgttgtcatggagattgaaatgcttgaaaatccttccttatattcagctgaaacctgtctctgttatctctaaccactgtggctgcacagaggaaagtataaccctttccccacttgctagcctttcagatacgggacaggtaaggacacatgtatgaaagcacattgtaagctgtaaagtgat

SEQ ID NO: 137286 - DNA, 1082 bp, Homo sapiens
tttttagatgaagtcccattaaactgttttaaccattttaaaacttgcatccacttattttttcactagataatttttgagtcttctttgtgccaggcactatgttgcattctggggatacaatggtgagttctacctttatctccattacctttcagttcctagcctcgcctgttggtatttttggattctagctctatttgaaacacattggctgtgtctccatgttttatatcattcatgaattttatgatcatgtttccgctgtcttttctaacttggtggtatttcagtagtgccaagtacagagccctgaagcattcaagttgatcttctgtgaggctgacattgatccattaattggtattctttaaaaactctttttattttaaaaacaattattgattcagataattatggttactgcaaacaaatgtacagggaagtctcatgtacccttcctccagattcctccagtgatagcatgttacaaactatagtacaatattgaaaccaagaaactgacattgatacaatccgcagggcttattgatagagaggtggagagggagagagaaagggaatggggggagggagggagagagaaagaaatgagagaggctccatgcaactttatcacatgcagctttgtgtaaccatccccactatgatcaagagactttactatcactacaagacttccttttgctgtccctttatatagccacatcccttcctcctcctcatttctaatccctggcaaacactaatctgttctccatctctataattatattattttacaaatgtcacataaatggaattgtgcagtatatatccttttgagattagttttttttttcactcagcataatttatttgagattcatcccagttgttgcatttagcaatagtttgttccagtggcattcttgttgagtaaggttatttgatcaatcataaatcatcctacttgttcaggacatacctgtctcatatgaacatattctatagggaaaaaatgtcttcagtgacttactgaaactcaaaaacacttcgttccattacctcagtctatgatt

SEQ ID NO: 137287 - DNA, 1030 bp, Homo sapiens
tagggaaaattgtctcaccatgctgattatatccatgaccaaactgtgatttctaaccacagctggatcctcaacggctgttcactaatccttttttacacattcctggttggtttattttccaaattcccacagcaactgttccattttcttaccacacccctcaggcctcctaacttagtcctctctatccccagcttcccctcagcaggtaatctattatatagattacctgctgaggggagctggagaaaagagagagcccattggtcacaaactttctctttcccatccaaacatttatttccatgggtactttcatcttcattcttttaatatcatcttttccaaggctaacctcattttcctttttacctatcccctgatgcatcttttaagatattctgttccattaatcatctcccttctctctcttgtatcttcagtgtttttcttaaagagctttttattctgcctgcagacatatccaagaatccccctttcatttcctaccccaaaatcttctttttaatcatactatccccataggctaatgggatatctttttctcatactttatttcaaagtatgttaaaagagccatctatacttccttatctttcagtcttcagctcttgaaatctggcttctgtacccttccctctactaaaaactgacctctcacaggtcagcatgacttccagattcagattaggtgggattatgtgtcccaagacacgcaaaacagaggagggaagacgtgtgtgtccacgcacaccaggttgcccatgcctgtttagatgagaaaagaagtatgaagcaggaggaacagagttcgatgctacatctttcttctattccagggtggttcatagtgtgatccagtaacacattacttctttctctgcttttattattgacaaatgtttttaccttctggtttgttaaattccataaggaagtgctacctttttattacagatgagatgatgatgatgatgatagtggccacctactgtgtgacatacac

SEQ ID NO: 137288 - DNA, 1010 bp, Homo sapiens
ataaaaaatttgcccaaaaaagtacaaagaacactcttacaccctttactcagatttcagatttacctgtttttagcattttaccctatttgctttatcatatgcattctctggtgtgtgtgtgtgtgtgtgtgtgtgtgtgtgtgtgtgtgtgtgtgtacatatttctgagacacttggggataaaggtacatacctcatggccctttacccccaaataattgagtatgtatttattgggaatagagacattctcttacacaactatagtacagttatcaatttcagtaaatttaacattgattatcttctctaccatagaaattctaatcttcaaattatttttatccttcctccctctgtttttgtgtaagttttatattgtacgtaatattagtacaatggtacatacatgggagtaaatgttgaaatgtttttctactgacagacatgtgcgataaaaagttatgaagcaaccggtccagaggttgacaaaatgctttcgctgtatcagctcagctgatcctgccatcacctcatgacacaggcaagagttattttccctactcatatcacatatgaagaaacactaaggaatttactaaagatataaagctttgattaacaagtgttggatatgggcctcaaccccaggatttttgaccccagagtctgtactctttccataccaaattaccttgctgagtaagctctcagctgtctacatgtgacttttctactttatgagttttaaggcaatttaagatcatataattctaaaaattgtgccagatgcttccaacatacagaattgaagacatcgtggttcagtgaggttaagtgatcatcatttttaaaccctcccttaagcaaagtaggaaaaaggaaaccttactgtcatttctcttccttcactcaaaatcataacccccatacatcctcagaaatgtttgacttgtctgcttagcaacctttatatggtgctttactgattacagtgcattgtaatt

SEQ ID NO: 137289 - DNA, 1098 bp, Homo sapiens
atcccttttgtctagccaactccttcctatctttattatcatttttcagaaagcttaccatgaccccctgttccatgtccccatagtctcttgggcctacttgatcacacggtctcatctattaattgtgagtattctaagagttgggacgtgttcatcaatccaagtatccccacagtgcctgacacatagtgagatggatgtatgagtgattaaacaaaaaggaccaaataatgagaaagacctgcatcctttgaacaagtggaagaggcttcatcgcttcatggaaagagagcttggtcattagtctaacttggtggttcttaaccagtggtgattttgcttttccaaagaacccttgataatgtctggagatgttgttcattgtcaaaattggctagggtatctactggcatctagtgggtggaggcccaaggatgacactaaccatcctacagtgcacaggacagccccccacaacaaagttagtagtgtcgaggtcctagaaatcctggcctaatcttgcttagctctctcttacctaaagcagttattctcaaagtgtggcccccagccgtggcagcattacctgggaattgttaggaaaattctagggtcctacccccaaatccctgaaggagaaactctgggaatggggcccaacactttattttaacaaaccctccaggggattatgatgcaggttaaagtttgagaactgctcctaaagtgaaaaatctggttggtaacaaggccagcaccagaactctgagaggagccagcacagaaatggttgagggataatgtcagaaaaaatccacaggaggtgatggtttccagggtgaagggatcattggtatcaaatactgctagatatgagaacaggcaaagatgggggagactgccactaatagttaagactcctgaaatggaaggaggtaaggatgatgttgttacaaagtgatgggtttgtgcaaggagggggtgctgaaagcttttaatttgtactcatctatgcaaaagaactgcttttaaaatttctatttaatgtcaggcatgtgggaatagcatgccaggactatcatccctctaaaacag

SEQ ID NO: 137290 - DNA, 1432 bp, Homo sapiens
aaccttgaggaaggaagaagtggcaacaaatattgaaggaaggatcagagaggtagtaggagaaccagaatactgtaccatataatataagctaaaaagggcatttcaggaattagggagtcatcttatgtcagatgccaaaagaagaaattgaggagagtaggaagttaaaaatccttttagctgtattaaagtctagtatatattaagcccatttgccatgcaaagttagaatctcattataacacaacctgcaatagtacagaatttgatacactcctattcagttttgtgctctattccaagaggatagatattcctggaagcatcttatccatgactcttctgctgcataaaccctagggacagcataagatagaagtttatgcatattctcttaacagatatacagcaggtcacagcagttaaacacgattgggtgaattcttccaccaagtttcagcaggctttttacccctccaaacaaatattcatatcaactttggtatgatgcaactaagatgcagaaacattagcctctcgctcttgaggctcaactcaagtcagtgaaatggggttggaactataatccggttccccagattgtctaatttgtttttttcttctctaacccattgagaaaataaagattaaccttcaactcaatatatcttgcctcctggacctaaattcagatcaagacgtattcctaagcttacattttagaattacagagtaaggtgtaggcggcatttgtcattctagtagtcaccacaccttaggtgggtggttgggcagaacagtgactgaaggatggagtgtgtgtccctaaacccgacacgccctgaaatcttcctgaattagtaagtcactttatccatatattcttgcacaataatggcgaaggggaagtaatttggatagctgctgataagacatttttgggcccgtgaaatggcaatacttcaaacagaatgggagtagctgtactaaaccaagcaaacagaattctttcgaaaatagttacggagtttctaccttgtagctgaggcttccgagcaagggtaaagtcagtcccttccctctgggagagataaagcacagtgcaagtaactggaatgcaaggcaggatgtgtctaagtgctatgtgagcgagtcatagcagagacattcttagagtgggttcttggaggaaatgtagagtgtaaaggcttgacagctcctaagaaaagcatcaatgaagagataatgaacctattcattctgccaatctaccaaatggtaagacgtaataagtttatgtagcaaatgaatagtgtaactgtgtctatttttacaggggacttgagctcatgagtaaagtccttccaagttgtcatttttgtttaaatttcccttgagcaataaagtaaaattcattcagctgccagtt

SEQ ID NO: 137291 - DNA, 1005 bp, Homo sapiens
tcctccctctgtgttctccaactcagcaaacagcatttcccaattgcatatgccaaggatatggagaattttaataagctaaaggttttggattcatctttgacactttttcccctccattctccaaatacaaactgctgtcaaatcttgttggctctactttcaaaatacatgtctaatctgaccacacagccacttctcatacttctcacttcctctattatttccacactaatccagcttttccctgggctgacaagtgcaagttctcttgcgtctgtctgtctgtctgtctctctgtctctgtctctgtctctgtctctctctctctctctctgtgtgtgtgtgtgtgtgtgtgtgtgtgtggtgtgtgtgtggacacaaagtggttggtggctgagagcttgagcctccttttttgagtcctctttctaatgacctgcatgccagattctaagctttcttaccatctgttctcgtatgtgtgttatttcatctgtaaaatagggataatgatcacctcatggatattttatgagaaataaatgagctatgtgtgaaaagcacttaaaacagtgctctgcaaatgtaaatactatactggtgttaggaataaaaataaaggaaaagaaagaaggaaggaaaacaaatatgttgtagatagtgaacatttctgaaggtacatatgtgaatgtacacaagcacaccttctcattacagcatgtctggggcacagtcatagaagtccaaggcatctgggatacgcatgcacacagtatacaggagagcagacctcccgacttgctttctctcctccatgccttgagtgtaggaccgttggcatcttaattaccctcccacacccaaggcttgcaaaaaagcgagccttctcttccctctccagtgcataggcatgagcacatggacaggtacaccaaagggaggtaaaccctctcttacgtgctctgtatgtggggtacactgttagcagccatcccatctgga

SEQ ID NO: 137292 - DNA, 1080 bp, Homo sapiens
tgggcttgtctgtgtattagaataaatgtccttattaaataatgtccatgtatgcaggtatccagagtgagacagtgagctttctctgtgttccccacctgctgtccacacacagggtggtgggcgggaaccagagccttctgatttgctccctcacttccttccaacctagatgtgagtgctgtctcaagtattaagccaaggattcaatgagatggagccttgcctacctatatgtatatatatggactgagtgcatatatgtctcttttcttgccttcctatatcttgagtttctagagtgtgacagatactctttttagtgttaaggatgcagtgacaaacgagagtcaaaatcactggatgtgctctctgatgggcagctttagaagaaaaattcagacgggcacaaatgatgggggccaaagagagagtcttcctattccccccactctgtcccctctgaggacagggagatgcacacattcatgaagatttacacttacagaatgtataggagtttgagcttataagctgccctttatcttccaggacatcctgagtagaactgtgagctgcctttagatgtctattacagactcttcttgaattagagggggtgaagagcaagggacccttcttattgctgatcttgtatgcaccccacacaatatggaaatgagaacagcctatatctttatattaccttactttagtcaaatagagatggactatacatgtctctgtttcagtctatcgctctctctgtccgtctctccatctctctctctctctcacctagggagtacaggtgcccatgatctgattcactcccctcctcccatccttagcgcctgagcctgagtgctttctactgtgacctcagcagtattcttcagttgttactctcttcttagctaagctgatctattcattcctccccatcttatcatttttgctcattgcccattgcaaatttatagtgttcaggtcagcgtagcaatacagtattataaatagtggtgacagagacagaaagagacacacactccatttcagtcctcaagttcttaaacattt

SEQ ID NO: 137293 - DNA, 1035 bp, Homo sapiens
tgtggtctatccatacagtgaaataatattcagccataaaaattgatgaagtgctgatacatgctgtaacatggatggatgttgaaaatattacgctaagtgaaagaaaccagacacaaagtgtcacatattgtgtgatttcatttatatgaaatatccagaatcagcaaatctatagagacaaaaagtataatagaggttaccagggcctgggggatggggagttactgtttgttgggtacagaatttctgtttgggatgatgaaatagttctggaaatggatagtcgtgatagttgcacatagtaagtgtactcaatgctactgaattgtatacttcaaaatggttcaaatggcaaatgttacgtgtaagggacttgaagatcattgttataagcctcctatttttctttctgcacaggtgccatggataacagaggctttcagcaggggagttttagtagcttccagaacagctccagtgatgaagacctgatggacattccagcaaccgctatggatttctccatgagagatgatgttcctcccttagaccgagaagtaggaggtatcattattggtgatgataatttatcttaattttttaaaatttatgtacaataaaattttatttttttttaattttattttctagcacacagtcctgtgagtttttaacaaatggctagattattgtaactaccaccactgacaggatacagaacagttcaactccctaaagaattccctcttgccactcctttgcagtcagacctccttcctccctaacccctggtaccagtgatcttttctctgtccttatagtttcttttcttttcaatgatgtcatgtacatggaatcacatagtatgtcactccttgagactgctttcactcagattaatgccttggagatatatctaagttgttcatttcttcttcttgctgagtagtatacccaggagtaggatcacttagtcatatggtaaatgtgtttaactttataagaaactgacaaaccagagtgccggtacca

SEQ ID NO: 137294 - DNA, 1051 bp, Homo sapiens
atcttctttcctaatatatacatttaagcctataaatttccctctaagcactgattttgctgcatccctcaatgttacttctcacatatattatattttcatttatttcaaaatattttaaaatttgtcttgagacattttgacttacaagttatttggaaatatgttgtttaatttccaggtatttgaggattttccagctatttttctgttattggcttctattaatagctcaattccattgtgttaggatttacagcaaactggctaggacttgggctgtatttcatgtttggtgtatctaggtgccagaggcttcaaattcctctagtgtgcttgtttttgtctctcctcttgattgtgagtttccctgaggacaactcctctagagagtctgtgtcttgcagctctttcaactgtgatccactattattatactggagccctgatgaggtggtggtgaagtatgggggaggtggtaattttataatcctctgattaaatgtcactgtttgatggaactgtgttttgtggctgtgaccttcatacatttttctccagtagtatactttttgtcctccctgccctctactctcttctttgactgcagcattcccaatgtgtttacttgaagccctgcaccttgttgagtatgttcccctgctttaggtgagataagaaggctagatgggatgggagtgggaggaatgtccttctcccaactgggataaggctcaggcaaagtattttcccctgaggcctttgttatggagaaatatctggcaagtttcacaatgatttctctttccctccccttgtcagagccaggagggattcttagatcttcactgtgagaacttggtggggttcctggatgtagagctttggtgtgggagctcccctaagaccgtggtccccaagagtttcttgtactcacgccagtccacactcagccttcagcagcttgttcaagttgccatttgtgtttctaccagctccagccatttctactccaggtaagcagatctcagctgtgtctctttgaataagc

SEQ ID NO: 137295 - DNA, 1022 bp, Homo sapiens
tcattagttaatgggtagatcatttctgttgccattcttgacagttaatttttaaaaatttattttctttctattaagttttaaaaatgctaagaaaagaaaccagctagatgtggaatatgaccaatgacttaagctgtttgtcatcaagtcagctatagatatcttgatgaaagtgtgtgaacaagttaaaccttttcactgatgaaacctaaaatagtagcaatggctgtcatcatcatcattgttatacattttaaaatatattgtttttcttattctaaaaatatgatgaatatttttaaattcacagtccacacttgtgtcagttaaccatttagaggtcttcatgtgctaaaagttttcaaaatattgctgtaggggccactggcattgtaaaaattgggaaatgatctggtcagatcagtgtttcagaaagaattctgcttatctcaaaatagtctattattgtgtttttatcataggatgcattaaaagttggtaagaatttctttatcttattttcacaataatatcaattgacctacactgggcagtctgtataatgaacacacactaaagatggtaagtttgccagagaaggaatggagagtagaaaagaataaaagaaataaagcatgtcaaactctgatactggtgcctcatttcttaatctaaattgtcattaaatcttgttttagtatgaggactgaatcatagccaccagccctctagttctcaaaggaagtaactgtacatggaataaaaaaaaaagtcccttccttggaagtgctgataaagcatttgaaaaacacatgaactttcattaaaagtcaataacgtggcaccagctatgcaatccataggaactatatatttttatgtaccaaaaaagatagtatctttgctaaatcgactgctaaatactatagctgctaaagtgtgaaataatcttatagataatgtaaatcatactagataatataagtgaattctttagtggtcttcagatactgttacag

SEQ ID NO: 137296 - DNA, 1939 bp, Homo sapiens
tgatatggaacatctagaggtatttttaaatgttcagtaactactaacatttcttctaaaaatgtgattgagtgattgaggaaagcagcattattctgtcactaattctgagttttggattttaggtcttgtcggctgcagcagcagctggtgtatctgtagcctttggagcacctataggtggagtattattcagccttgaagaggtaacaacttttcattgtacagcatgtgcatgcttttgtgtcaggaattttgtacattgcagcgcaataattttgtacataatgtacaatatctgtgtatatcccagtccctgagtgctctccccaacttggtgctttaccatgtgactagaaatccagtcggcagttttcatccattagttgactctcatgcctgcagcacaacatttcacctgaaatagtttctgcgtattgactgagtttgctttctcaccttctttcttctaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaaggtgaggaattcttttgggactcagtggctgcatgcgtagctgtgggttttggagggcagagcccaggtatcatacaatcctgatagctcatatggtgctttcaaatccccctcacattattcccccacccccaaagcctcttttaccccacacgttctcataatttgctagacacttgtacctctatctcaaattgtccaagccttgagttgtccaaatgccagcctcagtgatgaaattttaggaagaatgtttgctccttttctgtggaaaacatattttgcccctcaaaaatgatggtgaagtatttattccagtacatttcatattaaaatgatatctgaccaccacagtgttactccttatagggtggctttagagtttaccaataaagcacaatattgattgaaccaaagaagttgctgggattcgaccattttgactgctaaaatggcaatttcctgtggttcaacccaatatatagctaaatatagttttttacagtggtatcaatgttcagttgtcaagaagtgggatccacttcacaggtgatccttagttaatatttaagctatcaaaagtggacatcaggctggcacgttttactttaggtacctgttaccatttccacgtttcagaagaagccagaaaagaaaatttgttaaggtattttcctcctcctttctaggtttttgtttgtttctttcttttctttagcaccctaactaccaagttattttcctctattctctagagaaatggagattcaagccagaagagatagcaactcagtttaggcattattgtaatctctaagatgacgccatccatcccctcaatacagggaagggatggagaccctgagaaattttgcagtgcttcttgagttaattttcacctcatgcctgcattctttcacttaa

SEQ ID NO: 137297 - DNA, 1031 bp, Homo sapiens
tttttgtgtgagcaatgggctaagattcaatatatgagcatggttatgagcattccatttaaatcccagcaccagtctttactaaatcttgaccttgggtgggttacttaacctctctgaaccttaggttctttggcatttgggaataataatgcctgcctcctggggttataaagaacccatgaatcttgcatgtagagcgtccagcatagaacatggtaggtactcaataaagggtagtcattgttgataagaattcaaaattggtggaaatgtctgcatatatgagaaactccatctattttcctttttctttgggaaaggcccaatttctgcctccagttctgtgttggtctggagagttcaggctcttgcctgatggaccccgaatcagggtaagcttctttgcagtcgtccttgcctgcacgtcccagagaacctctagtccctgtagtgttacacacacctttacagccacttgctagcatagtgcatagttaaattgtcatcggcctgtttgctttgcagagggtcagtcctccagcccttaccatgtgccaagcaatcacatcatttctcactaaccatctattggtttctctttgcagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtgagtagtgtttgcattaatttcaagttgctacccaggtgacatacaacagaagagtttattaaacacagttgactgtaggagaatttaaatgcccatccctttccagttaggtttgccattttccaagcacattaagaaagcatctggtatacagatgaggaaactaaaaaaaataaaaataaaaatcataataaaaaagaaaaggaattctactctcatactggggaaataat

SEQ ID NO: 137298 - DNA, 1042 bp, Homo sapiens
cctgtaatcctagctacttaggaggcagaggtgggaggatcacttgaggttaggagtttgagaccagcctgggcaacatagtgaaaccccaattcgacaaaaaataaaaagttagttaggtgtggtggcacatgcctgtagtctcagctactcaggaggttgaggtgggaggatcacttaagcctggaagatggcagttgcagttagtagtgataatgccagtgcactctagcctgggtgacagagcacaaaacccgtctcaaaaaaagaaagagagagaaaaaagaaaaacagaaggcttcttgtagatgttattttgagaactctgaatcgtctccattgtgaccttgctttcttgcaatctctggggtctgcacagttgtaggtgagacctcattgtttttggtaggtcagcttttcctggaaaggcccataattgtaagaatcctgtattttgcctacctgagtagactgtgtctatttctttgcaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattggtaaggatttcagaaaggggatagtggaatccactgtggaactcaataaatatgcctgaaatgggggaagacagggaaggggggactggttaggagccagaaggatagagctagcacgtccatcttcaatttgttttttccttctgtttgaa

SEQ ID NO: 137299 - DNA, 1667 bp, Homo sapiens
gatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctggtgtctggtgtgtttctaaagaccctaaacttggtagctattgatttctgatcagaaaaccacaggggcagagtggaaggttcag

SEQ ID NO: 137300 - DNA, 1069 bp, Homo sapiens
tttccttcccctctctcctgacctggtatcttctcactataagaactgaggtatcctgggcagagaaaggactagttgtgtgctggtcttcctcctgggttctcaatcctctccttcctcagtttcctcacagttttactaatcctttgttgtggcaccaatttctttattccttatgttccaacatactgttgtgtatgagtctctctcctgagcttgaaggcagggactatacccctagcagtatctggcatgatgcttggcatgtggtagtggctcagcaaatgtcatttgtctgacaacagctagacaaatacaacaaatacttttaagcccctctgggtggtatcttgacttttcctctgctcctcattttcaaaagactgagactcatactcaaaaagttattgcaaaatgtgatgttaagtcatgtctcgtttccatctcaacgggtccgttcttttttttcttctttttcttttcgttgtgtcaggccaattagtagtatcttcagacttctggaatcttgattggtcatcagcctgttcatgtcccttgctcatcttcatcaactccaaaagtggcgatcatcaggggatcgtcttcctccgaaaattcaagcaataccttaacccatctcaagtgttcgacttattgaagggtggacctgaagcagggtaagcctgtatcccatggatatgattgggtatgtaagggagtcttccttctatacattctaaactaaaacaggcttcttggaatcagttcttgtatttgggcaggaaaggtctattttctcaagtcaggacacaagcacataactccagagccttttgggttggctggtaggagggctcttagccctctcccagaaatcccttcaagcccatgtccaagcccctgtcagatttgctttatcttttttggttggaaaacgtaaaactatgcctcctaacctgagagaaagagacaaatggatactgctgtctacttttcctgccactctctttcccgggaccaaatagatatatctcctctatagacctgttttattttgggaccatctggc

SEQ ID NO: 137301 - DNA, 1047 bp, Homo sapiens
cttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtat

SEQ ID NO: 137302 - DNA, 1038 bp, Homo sapiens
cttcatgccttgataattccttacaatagataaggacattctttttctcttccactttctccccctccttgtttacctgcctctttgcattcatgtgggtgtgtaataggtggtagttgacagggtgagctgcctgggcagggaggccaaagcaagagtgtgttctggcagcaggactgccagtgtttgttcactccactgagccagttgtcatctgcatgccctatagtgcatggttgggtttttttttttaatttcttttgctccaaagcaaaagccccaggaccatcattgctattattgctcagtgctctggctgtcagcagctccacctgctctcctgtggagagctcagcccactctctgctggggctgaggttcgggaggcaggtggcttataagtgctttccttaactctctttatagcaggaatttgcctgagacttgttgcggttagaagtaccttgttatcatgtcttttattgtcagacaaatctgtgacttgtctatgtggagctagttgatcagttttccagcccaagatgccataagcacagcatttacagggcctggctcccaggcactgttaagaatccttcatgagggggggaggggggagggatagcattgggagacatacctaatgctagatgatgagttagtgggtgcagcgcaccagcatggcacatgtatacatatgtaactaacctgcacaatgtgcacatgtaccctaaaatttaaagtataattaaaaaaaaaaaaaagaatccttcattagatcccatgtggctgcttctcaagctgttcttctacctggggagcattctcattgtaattagaaaacattttgtgaaaaatacctgtgattgttatctatcatagcagggaaaagggaaaatgacctcccaatagtaggcacttaacaaatatttaagaagaaagaacaaataaatgaatggatgaacatttattaagtatttcttatataccagacactgccagacattatgtatctatttcatttaatcctcccaatag

SEQ ID NO: 137303 - DNA, 1001 bp, Homo sapiens
ctgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtg

SEQ ID NO: 137304 - DNA, 1162 bp, Homo sapiens
acttgcccattcctttctcagagaaaaatgggaagattgaccagattgattttctttctcaaagagaagtgaggatgtgctcactgttcattaggcagcagcactcatttattccacaaatatttattgaacatctactatgtgtccagcactgtgatacgtgctcaggatactcttgtgaacaaagcagccctatgaagctgacattccatatctccagaatgaaggagacttgagaactaggagctcaggagggccactaagattcccacaccagttccttgcaagatgttctactttactgaaggaaaagagggggtggggcggaagctgcctgggaagtgatttcagctctggttccttcagcccacttcctgtccctttcttgctgtaggaggaacgcccctgtcagtaggccgcactcatggcatgtggccaagctgctggagggatgccctgaagcagccaccaccatgcatttcccttctgaagccttcagcttgtcctggcattctggctgcaacacaaggtgagtctagagccctcccctcaagacaggctggagggtagacaccttggacactcctcctcctctgctctagtccctgttggatgttagagcctcaagtactataatggaaaagcaagtgggagtccagagtacctgagttcaagtgctagtctcttgctaattctctgtgattttgggctagtccctttccttctggatgatgtttccttgaaatacctcattgggcttacaagacaccacactgtcctgcttttcattctatttcactagctgttctttctccgtatctcttttcctaattccttttgttctcctgtctcttaatgtaggaggaccccagggctcagttctggcctgcttctctgtcaatggcgactcactggtgcccttatctggtctttattacctctgtcacatagccaaagccttcaaaatagggaccttcctgaataaccattgttgaaacagttgcccaagaggcagacaacgttttcttcaggctgagagccagcaaaggtgctgcccttcactgccttttcccttccacaagagcttccctccaagaagggatttctgttgcaggttcagagaaactaagggttgcgtttaccccaattcggtgactttatt

SEQ ID NO: 137305 - DNA, 1047 bp, Homo sapiens
gatagaagatatagaaagccagtgggcagttgtagggagtaggtagaactggtgtggtatttaagtgagaggtcaggactagagattgtcctggagccttagaatgaaatttctaatctaaattaatctaaattctacataaatatttgcaggtggtctcttcatcctaaaaacataatctgcccttaacctttaccctcatccaactaccaatttcttttccttcacagccaaacatcttagacattggctctattttctcacctcccatttcctcactacagtctgccttctactcctaccactactatgccactgtcctctgtatggttccaaggtgaattaatgtcttccagattgaaaaaaaatccaaggagcgtagtttcttctccttttctaatgtgcaatttttcagtaagtttttaagccattattatatggtagaactggtgtcaaatcacatataagctagatgacctttggtaagttacttaatcacagtttccttttctgtaaaatggggataatgatatttactttattacatgagtaaatgagctgatatacataagccctttggaaatagtagttgcttaataaatattattttgtttcatcattgcagctttgggcactgttgagcactttctagaaatttgttttcttttattatcataacacttttttttttttgagatggagtctcacactgtcacctaggctggagtgcaatggtgcgatctccactcactgcaacctctgcctcccaggttcacgtgattctcctgcctcagcctcccaagtagctgggattacaggcacaccccaccacacctggctaatttttttatatttttagcagagacgggctttcactatgttggccagactggtctcgaactcctgacctcatgatccgcccaccttggcctcccaaagtgctgggattacaggtgtgagccaccacgcctgacgcataacacttctttttccttgttttcctactactagttatcttgagctctttttccttaatttgtcttatcc

SEQ ID NO: 137306 - DNA, 1079 bp, Homo sapiens
ttgcaactttgtcaaaaataagtttggcatatttgtgtgggcctatttctgtgttttctattcgattccattgatatatgtgtctgaccctctaccaataccatacagtcttgactgctatagttatcaaagtcttgaaattgggtatattgattcttactttattcttctttttcacaattgctttatcctagttgctctgcctttctggaacaattgtgtctatatcaagaaaatatcttgatgagattttgataggaactgcattaaatatgtataaacatttagagaggattaacatgtttactatattgcgtcttctaatccatgaacacagtgtgtcttcctattcatttggatttttttcttttttcagcattatgtggtttttagcatgcataccctatacatgttctgttagatttacatctaagcatttcatttttttgcagcaactgtaaatggtattgttttttatttgttttcacatgtctattatttgtatacagaaatgtgattgcttttggtatgttgatcttgtatgcttcgtacttgctgaacttgttttgtttgtttgactgattgattttgttagttttagattctttgggattttcaacatatgttatctccaaaaagcgacagttttattttatcctttccaaatctgaatgccatttatttctttggttgcttactttatctgctattaatatagccattctctctttcctttcattcacatctacatagtatattttttgtctttgtactttcaacctgcttatattatttgaagtgaattactgttgacagcatatagttgaatcatgtgtttttatgcactctgccagtctctgtcttttcattgatgtgtttagaccacttacatttcacatacttattaatatgttagggcttaaatcttgttttgttttctctttgttctcttttttactttctttactttcttttttctctgccttacagtaggttacttaaacattaattagaatcccattttgatttatctttagagattttgagtatatctcttcatattgattttttagtggttg

SEQ ID NO: 137307 - DNA, 1027 bp, Homo sapiens
taatggtcctagtcctttaaagtaggaattcaagaagcatcttgatcccctcttctctcagctacccacttcacctttatcaaatcagttaccaaatcctgttggttctacctcagatatgtattcattcaaatctcatttttcaaaacttttattgtaagttcaggggtacaagtgaaggtttgttacataggtaaagagttaataggtaaacttgtgtcatgggggtttgttatacagattatttcatcacctagatattaagcctagtactcattagttatttttgttgatctctccctcctcccaccctccaccttccaaaaggccccagtgtgtgttgttcccctctctaaatgatgacaacgtatggacaaatctcatacatttagcctccttgaacatattaaccgttccctgaatacagtgtcctctcatgtctctgcctttgcagatactgttctctttgcttagaatagtgtcccactcctttacctgctaagtctctgctcattgttaaaggtttctgctatgtattacaaactgttcctcatccctacaggagagctccgtcctctgtgcacttaaccacatctcatcataactgttagtttagatattgcttttctctactaaactatgatttccttgaagacaggggctgcattttaattatctgtaaagtctcagtatccacaacatgatagtctatgttaacaattaatgaaggaatgaatgatgtaactcaaatccaatttatcggtttttcctttgatgaattaatatatacttttggtgtcaagtctaaaaactattttcaatgtcctagatcccaaattttttctcctatttttttctaaaatatttatagttttacatttacattacctctacattaagtctatgatccattctgaggttttgtgtgcatgtttaagtatcagacttaggtcgaggtttgtttttaggcctgttgttgtctcattgttacagcaccatatgttgaaaaggctatctttttttccat

SEQ ID NO: 137308 - DNA, 1095 bp, Homo sapiens
gtctgagtcccaaagctgaagaaattggagtctgatgttcgagggcaggaagcatccagcatggcagaaagatgtaggctgggaggctaggccagtctctgcttctcacatttttctgcctgctttatatttgctggcagctgattagattgtgcccaccagatgaagggtggttctgccttccccagcccactgactcaaatgttaatttcttttggcaacacccacacagacacacccaggatcaatactttgtatccttcaatccaatcaagttgacactcagtattaaccatcacatccagctacaacatattctctcatatctctgtgccttttcacattctgctccttcttcccaaaatgatgactgctccttcctcttctttgtttagctaactcttattcaacactcaagacttgacctaagctttatcacttctaagaagtgttagggttgatatccccagactgtattaagcttcctcccataaacaacaccctttaatttcctctatctagaatcgtaacagcctgtttacttgtctatttcccccctgtaaattttgggcagtgtccatgtgttgtttttcctcctatcttaagtatagtgatcatagtgcttagcagggttacatgctcgatactcattgaatagctaattgaatggaatgaatgtatgccaggcaagggcagtaagggttattgcagtgaggattagaggctgagacttttaggggtattgggttgtcaggcatccaaatacttgaaagctgagatagtggattcagcaaaggaaagagatagagtcaaagatgagtgcaaggtttcttgccaaattggattgagttaaaagatactagttacaaatgctatttataagaactagcatttattgagtgcctcttagacactgagcatttgactaggtactttatatgctttatatcaaaaagaaacaaaataatgagctagttttagacatgtggaatttgaagcatctgtaagacgtccaaatataaaggacgagtagacagttgtaactatggttcttgggtacacaaagaaaaaaatgactcaataattaaattgaaa

SEQ ID NO: 137309 - DNA, 1061 bp, Homo sapiens
gctgaaagggactaaattggacctctggctgcctctctttcctccgtcccccacccctctggaaggaccacacagaaatagcagagaagagccactctaaagaaggaaattccacaaccttcattgactgaccactcagtctaacatttacctattttgcctggcaggaagttcttcctccttgcttatatcagtccttctcgttgcaatgtcagtttcttttcctttgctctgctttcaatcaaaattgagaacagctggtccttccctctaaattttttttatgtgcttagaagtcatattaaaccattcttcctgggtccaggtttaaccatccttggagctcctttatccttcccgcatgtatctgacttgccaaccatttcatcattttgccataggaaagcagcttaggcagcctgggcgaacagtacagcaaagcctaaagctttatggcttgtgctaatgggcgtgctaaatgtttagtagagactatttttgagcacgcaattgtgaacaatttaaagtggaccgtacatggaacccatttcctctcctggctcccccaacagggcctccccttagcagctgaaatgagttagtggcaatcagcgcaaagtaggaatcctgtggtttctgcccttccctcctgctgcttctatggcagctagtctcttaaaatgagcattctctctagaatagccagtaaatgtgacattggaatcagttggacaaagggtctaggagtcactttagctaaatagcaggaggtgctagtgctgaagcaccactggaggttttaggagaggttgaggggacagggttgaacagcgattgatgaaagagtttggacccagaatatttgctatccacagaacggttgtacctcagagttgtacatgccttttttgcaagtttgtagaggacgtttctggcctttgttcacttggcctttgtccactgtctcaactatgctaaagtgatgccaggaatctgtggcagaatcccagcttcagggccagttgggttcctaaaagagaggagggtaacttgccatgcat

SEQ ID NO: 137310 - DNA, 1118 bp, Homo sapiens
gaagcaggcctggaaggcttttgcaagaccctcctgttatttaggagtgtgggattcccgtgagtgtattgctggctgcctttacccattaaatgcttttggttcattttaatgctttaatttccttggttaaagggagagtccacaccttagggctgcgctggggtttagcaggtactgatgaccagaggaaaatctactgagtgctaaatgcaaacaagtcaaggactgaagctggcctgagagtcagggaccccttcccttaggtaggttttagcctaacttctatacatttgctgtaactgaagccccacccccagcagctacattccctggccttcccagaacattgctgtgggcccccatactagatttccctccttcctctggacatctctagaaacatcttttctgcattgctgcaaactttcattttaactccctctctgctattacttaactcaaggacagaggaaatagctgcagtccagaaacagaataaaacaaagaagaaagaaagagaagaagccccaaactcctcccaaatctttaagaaaacaatcctgtaggatttggttgggaattgccatgcaatgtggggaatgtgaaacatgtgctaatcatggccctttctgcttggatcctacctgacttctctccaccacccccagccagctgggctaggctaggcccaggggagccacaaagctgccagcttagaaaatggagacaaatgaggaggccccagaggacaaagcaagacttgttactagttttgaggccaaagcaacacatacagtatttaagggctatgggggtagatgctgcaaagcctggaatcctagctttgagcttaaagattcaggctaatttgcagtgactgactgtgtcagaggtgtttgaaccagagcaactccatcttgaatagaagctgggtaaaatgaggctgagacctgctgggctgcattcccaggaggttaaggcattcttagtcacaggatgaggcaggaggtcggcacaagatacaggtcctaaagaccttgctgatacaacaggttgcactaaagaagccagctaaaacccaccaaaaccaagatggcgaccagagtgacctctgg

SEQ ID NO: 137311 - DNA, 1033 bp, Homo sapiens
attccatttaatctctttgtagccttttaatgaatgacaaacctgcatgagatgcagcacaaactggaagatggcatactggcctcaattttgtaagatagcccttgtaaaaatattgcagtaagcatcttcgccaatttctgacacagcataactgagttagagttctacattccatggatagctatttgtcagaacttttttttaatattacaagattccaaggtgctaaacacagatgcttggaatgtaatccagcatttgtggttcgctgtcatgtaaacagtcaaagtcacagcctgattctgaattcattcatgggttttctggatatttcccatgctctttttgaagaggggcatttatgtgaattagcacttttaattcgtctgacagagtgatataggcttgtataaaagcaataaaaatacagggtcccaggtggcatttattgccacacagatgaaaagccatatagttggaattctcctcttatgagaggcttttgggatgtggagggaaatccctaagcttagcaatctgacattatagtacagtggatagagggtaacctaagtgtcagatctgagtttcagtttctcctgtgctagtcactatgaatatgatctgggacaagtcctttcacctccttttacctcagctttcccttgtgtacaatgggaaaaaattgtaccaactttgtggattggttgtattataaatgagattaacaattctataccacctagcccagtgcttgatatatggtaggcaagcaataaatcattgctcttaggatcagttctagttgataacagctaagcctgctggagttgccatatcattttcctcttgaagagtgaaagaagtaatagcatgtgtatagtttggggattcaattcctgggtctctgtagaaactggaccaccctgagtccctcagactgtgctgggagtttataatcattcatgtgaaggacaatgggaaaacattgggttgcttaatagcccttgctggtacctaagcaaagaca

SEQ ID NO: 137312 - DNA, 1086 bp, Homo sapiens
agaaacaagggagacaaatgttaataacatattttagttaactactcaatatatctaaaatattaacatttcaacatggaatcagtataaaagttactaatgagatattttgtgttcttttttaatattaagtctttgaaatctggtgtgatattaaacttgacaagtgtgtgtcaatttacaccagtcacatttaagtgctcattagtcacacgtggctagtggatggctactgtactggacagctcagtgctaggccttgctcccaggtatactgaaatgtattagaaacctttctgtgaagtgatgaggaaaggcacataaactgcagtgagcccaataacaatttgttttgcagaaagctgttctttaaattattacccatataggttacaaattatgagattaaaacccgatgtaacattaacagtccttcaagctccttcagagtctcctccactggatttgggagagtaactctcttaaagcaggacatcattttgattctgcaaatattctccaaggcaaggaggttacatatctctgcagagtgtctgtgaactgaggcctgaagcaatttaaggtagggacttcagggtcatcaaagaagaagcacatgccactcaagtcctttacgtaatctagaggaaagaccaacaaagaactagctaatagtctgggaattatttctcgtttccctgttctctgcccttcttcaccatgcagtctattctcccaagacactccatctctcagaggttcccaatctctctctatagtctaggggatgtataactatataagtgagggtatgtgaccctatgtgagattaggtgtgtgctgtcatgggtcagctatgtaaagtatggagagtgagttggcagccccaaaagcatagctatgaataatcaagtaaaaagattctccccatttcatgtcctctcagaagaaggagacataaattaatggggcctgtaggcactgagctgacctgacaatttccatcacagagtttccctgtagttgcaggggctgtctggcataaatgaggattccaacctggaatttgatttttctcctttagag

SEQ ID NO: 137313 - DNA, 1033 bp, Homo sapiens
ttgagatttttcaaacagctgccagaaagcccatggtgcaggagaagaggccctcatgtcttgacctcagagagacccactggtccttaatttaatgggagcctgatatttcctcagttacagcagcaaattagaatttggggcggcaggatgggtgggtttgaggaggtagtttactctagaaatagacacagtgacagctaagtaacagacacccaggatggagaaatcataaaagcaaagacctggcaatgtggaataggcagatacccttacacatgaaaatataagattgtgtggtattgacatgccagattttgcttagccattctattattggagatttaagttattttaaaatttttactcttataaaaagtgatgctgtgaatggttctgcacaaattgcatttcttctgtttagagttattgctttctggtatcttaccaaatgtgtaataacgaggccaaaaggtatgagctgttttatagctgctgttacatgttgccagattgtactcccaaaagattaaactgcataagtgtgcctgttttcacagatccctgcagcactgaatgttatcatttttaacctttttgctagtttagtaggtatataagtatactatccatttgttttaattttatttaatgaggcttttcattttttagtgtcataatttgctgtttcctcgttcatcttctttcaccacttctcaagtaaaatctgggtaatgaccttatatatttttatccattctctatattttggatagtcagcttcatcatttatatttgtcacatatttttccaattttattgctttcatttttatgtatgctttatcatatttcactatgcaaaactattcctttttacatttatatattcaaatccatccatcctgtctctaatgtttctttcatttttcaatattcagaaatttaccactcctcaacagctgggacaaatatgtgattctgtcttccccactcccccagggtgtttttttcttttttgtgtttaatttttg

SEQ ID NO: 137314 - DNA, 1270 bp, Homo sapiens
tgttttttgccaaccacacagtttaggaaagcactcgaatagagaagcacaaggtctcccaagctgcttctgcctgagttgttctgctgcgctctagagaaccaagactgaaggcctggctactttctttgtgtgtgaagggagggtggggaaggcagatttggggagaaatacctttttactaagacaggggtggttggtcagttccagcttaaagataccttggtcacaccttcagtggaggcattcagctttctagtgagcctgacattccacagagttcaggccagtctagagagcctaactgacctacccactcctctggcttcctgtttttctagcagccagagtgcctcttgagcgtaactttattgtaagcattgttgagtagggggaagtgtgtgttgagaagtcttgaatctggatctcctcatctaacagcctgcattctctctgacttcaaaggctgggcattcatccaagaatgatgctcttggcctctgctagaaggtggggccaggtgtgggaatgcaaacagactgggggcctgtatgagggtggaaggcagcaggagactatgtgaccatggagaggagcagacgcctggtacttggccaggctccaccttacaaagggtgctccttgcaggaatgttttcaatgatgtctgtcagggagctagggctatttgaacctctaagtctgaattgggtgatgtttgccataagcagtaataagcatggaaataatttactctgggaccttgactgcattagtatgaaatcactggcatactgatggggcctattgatcctcaaactgtttcctgaattctctctgcaaatccattctttcctgtcccagcaaaccagttgtcactgctgactgtgtatgtatgctgctgccttgaaacacagtatgttggacttattcattcacctttctatccaggtcttcagctcactgagctgtgaaatttccccctcccaatctgtttacttttcttctgactttgtttgtaagcaaacctgtgtacataccttttcatgtgtttacatgtatttcttggaatgcatgctggctccccgaggctatttgtaagtctgtggctcttttatataaagggatgtatctcctctgagtgtacctagtcaggcacttcaattgagtgcagtgggggtagtccttggggcaggggagttgctgtgctggaagagtgattgacccttctcttggacaggaaggctttggtaagaccttaattgaattat

SEQ ID NO: 137315 - DNA, 1055 bp, Homo sapiens
attcattagcatgaatgtcttatttatttgtgtctttgatttctttcatcaatgttttatagttttcagtatacaagtcttttgccttcttagttacatttattcctaagtattttattattttaggtgctatagtaaatgggattgttttcttatttttttgaggtagtacattgttagtgtatagaaacactgttgatttttgcatgttgattttgtatcctgtaactttactggatttattagttctaacagtttttttatggagtgtctaggattttctccgtataagatcatgttatctgacaacatacaagatcatgttacctggtaagtaaaaaataattttacttgtttctttcttattttgatgcctttacttattttttcttgcctaattatgctgggtaagaattccagcactatgttgaacagaagtggcaagagtgggcatttttgccttgttcctgatcttagaggaaaaactcagcttttcaccattgagtatgacattagctgtggggttttcttatatggcctttattttgttgaggtaatttcattctatttctagtttgttgagagctttttatgaaaggctgttgaatttgtcaaatgctttttttgtatctcaaaatgatcatgtgctttttatcccttattctgctaatatgttgtatcacatttattgatctgcatatgttaaaccatctttgcataccagacataaatcccacttggtcacagagtatcatccttttcctgtgccattgaattcagttttctggtattttgttgaggattttcgcatcagttttcattggggatattggcctttagttttctttttttgtagtgtccttatctgtatcaggtataatgctggcctcataaaatgagtttggaaatgttcccttctcttcaatttttgggagcgtttgagaaggattggcattaattctttttcaaatatttgataaaattcaccagtaaagtaatctgttcctgggtttttctttattgggagatttttaatttactaattcagtctcctt

SEQ ID NO: 137316 - DNA, 2005 bp, Homo sapiens
aagtgaggggtggcctccctctctccctctcccctccttccttctcttctagcacaatttatttatttaaatgtttattttggggatagatgataaatgttcatggaacaaaatttttaaaactatataaatgggtacatctttcttcattcatgtccctaaaccacctaatttcccttcccagtggcaatcactgttaccaattccttgtgtactcttccaaagacacccttccaaagatacattatatgtaggcatgttgtatatgctcatatacgtgcatgctcagtgtctctgtttcctcactgcctgtcttcctgaatcctctccaatctggcttccaatgaggtcttcctgagggccaaatatactggccttctcactgttttcatcatccttgttttctctatacaattattgtttttcaataatttgttgaataggtaatgtagttatgtggtttaaaaggtagttagtatgaaaaggcggagaatagtttcccagtcatccttgtctctcatctgtccagtttcaccactacctcccactgtgcttagatatttctgtgtgtcttttcagagcctctctatacatacacaagcaaatgtcaatatagattctttattttgccttttatacaaaaggtagcatactaaaacaatcttttgcacttcgcttttttcacttacatatcctagagatctttccctatcaagcatacagaaggttatctctattttttaacagccacattgtatttaattatttaaacagttcttagtattgctagtcattggcattgtttccaaaccattcagactcgaccttctccaaactctgctgccagtatagctcctgtaatactgaactctcctgtttctgcatcttctcttgctgtttctccattctcctctgtaaatcgactgcctctcttatctctatcctgtggatattcctcaaggctcagcactcagtccctccccccgcactcttttctctgtttcttctttccctattctccctccccccatcctttccccctctcctcttttcctcaagaaagcaacgatgagatctcataactcctgaatctctagtcttaatcttttccactgtctgatagtattcactggaatatttcttttttacctcataccccagtatgtctaaaatggaacttatcttccccttgtaaaatgggctctttccttggcttccccactcagctagcattaaaatcatggagtcattgcttactcatcccatatcccacattctgtcagtcttgcttcctttacaatagccctcatatccacctgcttcttttcaattcctgctactcctaccctcttccaagctcttattactttatgtctggtttctggattcctggctggcttccctgcttctaagatcactcctgttaaatttatcttataagacacttcttctatccaagaattttagtttccctttctatacaatgaggaagctggactgactggttcatctcagaggtgggttaaaatcctagccctaccattccttccacctccgacattctagaccagaactccatcctttccacctctaacattctagaccagaaatcttcccagtgtctccccacctcccaccatttccactctctgtactgttctctttcacttgaattgttgctatggctccatgctcccagcagtgccttgaaaaaatctttcttccatattggtcctagagtctttatcctaaattaacttacagttgaaaggaatcttagaggcaggccatccaagctgaccaacactaacctgctgcctgagtgccattaataacacccttgaatttggttggtcagactgttcttttgaatgcttccattgatggagaacattatctcataagccagccctttgtattgtcagatagcaagagttgttctatatctcctaccacaaactgacaccaactgatctgcctttatgatactctattattaaaaact

SEQ ID NO: 137317 - DNA, 1037 bp, Homo sapiens
acattcagaacagttctggagaagcctatttaatccatagtgtatcattgattaaattacacaacctaaccatcatttataatgtcctatctacaggaaacagaattcaaagctccaagctgcttatttatagaagatattcttgggaaacaatgcattcataagttaggaacaaaaagtgctctagatagctctgttacacagttctgggggagtttgggattctgctaccattagtgcccaaggtgttcatacctttgatgctgggaccagatgtgtgtgcatggttacatttccctctgaaacggaattccaggtttccctgagagttatcttgtaatcagcaagtaacgtttttatattggttatgtcggtatcaagatcactttcactcagcttccatggagccaaaattttgtctcctggtgctccctgagatatactcccttcacacataattcaataaaatcattaatgaataagttgagttactattttttatggctaaagattgggttccaaggactgggaaggggtagaggtttgtctccttatacctctttgccctatccagtgtaaataggccaagtggaaaaattgtcttacgcattagtgttgcaacggatgatccattcttcctcacatcacactggcatgtttgcttggtcagatagccatcctggccacgcactgaagttgcaaaagtcaagatgacttgatctttcaaagtgagctctaacctctcccctttgacttcacatccacatcctcctctttcactgtgaatctatgactgtaccatatcgcaacacaagtactgcctagtagcaacagagacacattttccatgcatctaggctgtccttctttcatgtcaagtctttagttcccatcccccacccaagagcaccagttgcttgaggcctacattttggaccgtctcattcaagtgccattgcccctttgttcattcattgactgccctgccctctgtccaaaacccaacttttttttcttttttggtcacagtgagccct

SEQ ID NO: 137318 - DNA, 1114 bp, Homo sapiens
ttgttaagctgcaatcgttttccttttagcgatcatccatgggtcctagctgtatcctctggatagcatcacacagaacaagggtgcttcctctgtcttgggacagcccttgggatatctgaaggcaaatattatatcatcttgtttcacttttctagcagagccctagctctttcagctgttccttatgggatgtagattccagcctctcctcctgtttcctcctcccactcatgatgcacttcagcttgtccatgttcctcttaagttatggatcccacagctgaatactgtaactgaggagaatctgaccacagttgagtatgaacattctttaaaaaaatacagctgaagatcactttggctctttctggcggccatgtcataccaaggccctgtgtcaaaatcttttaatggaagtagctgtgctgctattaagccatacctgcctaaggcctctatgaaggcatctgggacagccacataatagatttgggagggacacatttcatctcctactatttatttagaattgcctctgcccctagccctggccagccttggtaaatgcatcgtaggggagatgagagagaagatataagccctgacttcaaggaacatgtatgtttaaacaaagagattattaagttacagagaaggaatttgtataatagaagaaggaaatggcatttaatgaatagtgtcaaagtcagaattccagatcttttttatttcctttttacctctctgaacttaattttttccccttctggaaagaatagttgtctccaagattgaagatgctaaccatatgtgccatacactcttcaatttacagagcccctatgtaggaatatagagacagcagtctctgtccctatccactgtcagatatatatttccctgcatacctccactgacactgattggaaaagcccctgctgttgctgccatccttcagctctgggttcttctgtctgtacctggaatacacacaagagtgactcctgctggaggtcttgcatccacagcctctttctccccatctccccacatttaccagttgtcatctgagctggaaaaatatctttcgttactactaaagcctcgatca

SEQ ID NO: 137319 - DNA, 1100 bp, Homo sapiens
ctatttgcagagtggggcctaggcataactgccccatctctattatcacagatgatgagacaatgaattaggcaaactctaatagtgtttgccatccttagcctaggacagtggcagggcatgctcatcaagttgttttagtctgtattccattcctagtctgaccttatttctagaagcacacagagaggcagttgagacttcaagaggatctggataaactcagatagaggttgtcttgtggctggaagtaaatttggctgtgattttgaattcttattgggtgcagaggtggtattatgtgaacaatgagagttcctgtgaaatcttttgagctgtgttacagaccagtgcctggcactcacaaagggaccttcgtggggtgtgcatctttggagcttagtccagcctggttacctacatgaatcccctcctcatttctgcctctagaatcaccaaagatgtccactacctcagtttcccacctgctgccctatcccagaaagtagagggcattttgaggcatggattagaaatccatcagagagatacaaagaaggttggagggaggtggagcaagaagggtgggtggtatggctggtaacccttggctgagctttgagtcgatactacttttggccctgctgggttttcataatacacctggtaccccattgagagccacatgtatgcttgctgaagttaaaaaaggtcaagcctattagaggattttccctctccaaaacttcacacaaagaaaataattcaactccattgtcccttaaaaaaattaaaatgatttccccccttgccttccccaaccccctccccaggaatttctttaaagaaaaaagagagactcagacttgagattggaggttatggatgattatctggagggaacatcatggcttttatagttagacttctttagaactaagggaaaaaagatgctgacccatctgagaaaagttaatgaagaacagcagggattatgggaagggctgctctcactgcctgcccctctacccctcaagcaccaaggggcagacttaactcagtgctcccagagtaattctgttcttggtagagacctagaa

SEQ ID NO: 137320 - DNA, 1220 bp, Homo sapiens
gtgaggcagtcaggaaagattgtggagaaactgatggaaaacccgagactgatgtattcagtggcttacctatgtctatcatactgagagtcaatggcagtcctactaagagagtttctgattcttctgttagtactgtggtttgtgaaggagcacagggcaataactttcagggatgtatctagtcttattagcctcctaatgcagtgtccctttccatgccagcctgtaattccatacttggtgacggactgggttgtaggtacactctgatggagtctgggctcagagtaggaaaggactattttgatgaccccaaatcacttgtgatgatctcaggtcagggagagacagaggtaaggtgcaggaagcatggtggaaaatggcagagaacctcctttgtggaaaaaaaaccagaagcggtttgcatcagggatggtgtggcatacatgctcagagatatcttgtggcacaagtggagatatctggggagtgggggaatttgaaaaagtagtgattagtgggggaagagggtatgcagtgtgaaagtctagttcatagttgtcatgggagaccctttggaccaggaaatgatcaagttggggaaatcatcaattcctgctggttcctatgatttccctgaatatggggaattcaactgcctgatttatggacacttgtatagtaccccccgacagtcaagtggcaaagaaagagaaaattttttaatactattgctggatgcggtgtcttgcacctgtagtcccagctactcaggaggcttaggtaagaggaatccctagagcccaggaattccaggctgcagtgtaccatgattgggcaacatagtgtgaccccacctccaaaaaataaaatacgattgattatcctaaataataagggatagtttatgatgtttccctatattgtggtgtttcgagtgagatcatggtaacaagtaaaagatacatgacccataaaggaatagggcccatgacattggcattattgattcctttggttaacatgttacgctacctcattgactcagaagtactgtctggatggaatggggattctcttctaatcagatgtgtctgatgatatgtaggctcatgctaacatattttcccttttcttggctcgtttatggtagatgtttctatctggcatagtgaagcaagtggggctagttactgccctggaacaaaacagagtgg

SEQ ID NO: 137321 - DNA, 1529 bp, Homo sapiens
gcctagaacagtgcctgaaatttggagacatttgtctttgatccacagattagaaatgtctacaagtgtattcccgatttctgagcttcataatgtacctgggacaatctgttattccctcaggctctcatctggcctcacagtgaaactgcattcgataattcactgaaggcttttccaattcaaaatggttgatgagccatagtaggtgctcaataagtatttgttgattagaggaatggatgaaccaataaaaccctattaataagaatttttctttttaggtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctattt

SEQ ID NO: 137322 - DNA, 1068 bp, Homo sapiens
atgtggtcactggactgaaaactctttcgtgggtgggaatcagcctgaattatttccatgagtctagagtctgtaacatggaatttaggatattttatgtcttaaatggtcactcctcttttacaaaacttctgatatcgctgctttcctgacttttttacatcatggtatacattggcttataacccctcagttgctgatccagactcattgattgcatctgcattagataattctgtggaagtgaagtgcttgatgcaaagtgattgatgtacataataagctcttggtacatttgtcagttggaggaattattaacataagcctgctaattgtgtgttggtttgtttttccagatgaacagcaaagatgttcagtattgtgctgaaagaaacattgatgtgaacccagtgatcagtggaattgtcaagtacaggtgagcacttctgtgttcccaagaagacagctcatctggtttcttcctgcatcttgggacactccttccctgtctataccactgactcttgctctggttgttgtactcttatacgtgaatagactcttaattcagcacctatagccttttgttgtgcttttttgatgtgtctgccttcattagactatgatgtctttgagagcaaagactatttttccttactctttgcatattctgcatctgagacactacttgaaatatggttggcatcactgaaggttctttgattcaattaatattttgtaatcaccgtgtggcaaaacattccccttccaatctggtgctagtagagtatatgctatctaggcaccatgtgtgtggcttttgtgtatcaggtgtttcagaaatatttcaagacagttgtaagatgtttgaggacaagaattattactcctatttctatgtcataccacacagtagctgcacagttttaagattatgccatcacctagggtaatgttttgtagaatcagtccttcgtgtaacaactctagtgtttttgtactgttgatgatttgcttaaattttattcaaaaactatcacttgctataaaggtaattgtaaaaataaa

SEQ ID NO: 137323 - DNA, 1060 bp, Homo sapiens
cactggaaagggaaaatcaaaaggcctgtggatttcaaattaatgagtgatcttaagttgcatttcctaagttcggctacagactcatatatttcatgagtccctccctacccattccttgcctctcccttcagttgctgggtttctgaatttctgtatagttaacccttatcttgcctcccatttgttcaatagaaatgatcacttttacttgaatcttttggtagaattgtataccatgtgttcctgtctaggtttaatcatcagattgtggtcaaattgctctgccagactgtgtgaacaaaaaagtgaatggaaattttcgttttaaaaaataatacttttggacttagcccgtggctaagaagaagtaaggaagccaagcgtacggatagcagcgaggggtcaatccacgcccggcgttgggtcgggggtggaggagtcggaagtggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaagg

SEQ ID NO: 137324 - DNA, 2350 bp, Homo sapiens
aggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaatgaaaggctcaggccgtctttatttgtatagcagtagttcatgtaacattatccataggttcttgaagactacaacattaagcaaaacaatgtacagcaggtgtacatcgtacaacaatgcacaatgtatgacattgttcaatgttgttatgacattgttcaatg

SEQ ID NO: 137325 - DNA, 3008 bp, Homo sapiens
tgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccat

SEQ ID NO: 137326 - DNA, 1102 bp, Homo sapiens
ggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctaca

SEQ ID NO: 137327 - DNA, 1032 bp, Homo sapiens
acgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacct

SEQ ID NO: 137328 - DNA, 1069 bp, Homo sapiens
gcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctc

SEQ ID NO: 137329 - DNA, 1153 bp, Homo sapiens
ttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaattt

SEQ ID NO: 137330 - DNA, 1070 bp, Homo sapiens
cggcctcaagtaggatcctgtcacttcctccagtggggcagctgagattacaagtgcaggcccactgctgttgggaagtggtgagagtttctctccaatcgctcctgttttttcaggggaatatcaaggaatatcatgagaagagttggtgctagtccttgtgggggctattgtagggagaggagagagaaggtacacttgtggagggtgcacattgtttgtctacttggttacaggggggcgggggaaggcagggggttgccaggcgagtagggaggaaggaaaatgaagagatgcgtttgaggagcgagagttaatagctttgagtaagctgggtaaggaaggtgaatggtgaggaacgcggttggggtcagtggacaggcctccttgaggctgaaggctgtggatgctgggacattggagagagggagctgttaggactggatggggtgctgcccatgatgagagtgcgggatgcaagaaatagacatcgtgaaggggcgcggtctttcctgaggcccagagcattaccgcgcgcggaggagacttaggtggggaggaggaggccccctcaagacggaggagagccggccgcggcctggtcagccccgggggcgctgaggtcgccggggaggatccgtgctgtgagggctgagaggaggacagggcgtgcgtcacatgagaagcgtgtccaggggctggctgggagagtgtccatgggattggcacaggtctcgaacgtgaggcggctggtgcagccatgcagtagagcctggccttcagcggtcgcgagcctgagccatcaactctcaatagcagggaaggagtcctgcggctgaccctgaggagactagcgcctacctccccggactccgatgcgcaggcccagagcccgtcaatcctaggccagccccgccccgagagctgctttttccggtggcgcaggaacttcctgctgggttgctatggttccgagggcgggactatgggaggctgccttgtacggccggttcgtcggggcctgtctgaccggtactagtctattctctggtcctcatcttcattctgcg

SEQ ID NO: 137331 - DNA, 1041 bp, Homo sapiens
gcacacctgggcagagggagtgctggtgagtgcacatgtctacgtgtgtgtctgtgtgcggtgtgcacgcgttcctgcgcaggcaccctgtgggtgcatgcactagtgactgtcaatcctctgtctgtgggctggctcccataatccatgctacgtcctgaattccactgccggtttttctgttcaccaatctcaaggacctggcttcagtttctctggtaaccaacctcagcccttagcttcaacctctgagcacaggaagacagccagagtggggaggggtgttgtctcacccacagggcccctgccggagctgagcaccccaatgggatgagtggcagcacggttaccaagacaacagaactctcgacccctttccacctgcaaggctcttctccctctcctgggcctgccgagcatcaggtcggaaaggtaaagctgtggcataaccaccctcctaagtccttgaaattgctctagacgtggctgtagaataaatatgtcaaaagatgctcttgaaagagaaggcaacccctacttttttttcccaattcattaactacaaacaaggctatgaagtccaaggttatatttaaaaatcagggcaggcgaaagggagtgtgtgcttatgtctctcaacgtcagctgtgcatcaggtctctcgtggagcatttgtccaagagcaaatgccggaccccatccccagagagtctgacttagcaggtctggaatgtggccccagcatgagtatcattttataactcctcttatgaaagacgaggtggcagctgcagaaacggaaccatcctcataggaagtaaagcatatctgaaacacaaggtccctcgccaaagggaaagcaggacgtctttgctccctgctgtgctggcggtttctagggctaatagatttcccgggctaaggaaaggtcaaaaacattcaaagtaatgtgagtgcgtgttttacagctgacactgtgctcgccttcctctatattcctgaaatcaaaattttcacgttaacatgctgcatttgccagtg

SEQ ID NO: 137332 - DNA, 1041 bp, Homo sapiens; identical to SEQ ID NO: 137331

SEQ ID NO: 137333 - DNA, 1041 bp, Homo sapiens; identical to SEQ ID NO: 137331

SEQ ID NO: 137334 - DNA, 1091 bp, Homo sapiens
ggctgtgtgtgtttcattgaacatgtctgtatatgcctgcctgtccatacacatatgtccacacacatctgtccacacacacacgtgtgtgtgtgtgtgtgtgtgtgtgtgtgtgaatatgcctgtgtgtatgcctgtacattcagacaggcatacacagaggtatattcatatgtgtgaatgtgccagtttgtacagttctaattatttgcatgtatgtgtttgtgtttatgcatctttgttctggagcatatgttgtagaacacaatgtaaggtaacgtccatgcatgtcactctcagcctacaagtgtgtttaagtgtgtgtgtgtgaggatgtgtgtgaggatgtgtgtgtgtctgtgatgagtgtggatcagtccttcttgtatggatgtacagttgtgtgcatgtgagtgtacttccatgtgtacatgtgtgtgaatatacctttgtgtccaagtccatctgtgagaatgtaggtgtaaatgattcctctttattgtgtagcttctcatatgggtgtatgaacttgtaggaatgtacatggtgtacatatctggctgtgatagtgtgggcatgttttgtgagtacatttgtatttccatgtctgagtgtaagcatatgggaatgaattaatgaacaagtctatgtgcatgtgaacatgcccagttgtgtgtacaagtctgtgttaggaatgtctgcatatctatacttcatgtcatttacaagcatgtgcatatctaggtgtttatgtgtgtgagtgtgtaaatatatgtggtcatgtctgggtgtgtgtgtgcacacatttgggagcttccctgtctgtgtccatgtttgttcatcatctccttgggtgtgatacaaagtctgtctgtctgtggacatgtgaaggtatgcctgtatgtacccctgtgtttgtgagtgaatgtacgtcattcatgggcattatgtcatgtgaatgtatgtcacgcatgcgtgcctatgtttaagagtaaatggatgtacacgtatgactaagtacagtgtgagtgtgtccatgtgtaaggatgagtgtaggtatttgtgcatgtgtctgtcagtcgatgtgagag

SEQ ID NO: 137335 - DNA, 1050 bp, Homo sapiens
tccaagtgtggttatatgtggatgatatgtcagtaggtgagagcacaagtgtatctaggcaatggaagtgtgtgatagggtgtattgtgatggtgtgcatgagaaagagaatttgggcacatctgggtgagggtgggggtgtatataattgggggtgtctatggagtgtgtgtatgggtggtgtgtgtgagacagtatggatgtatctgcattgtgtgtgtgcagtgtgagtagatctggctgatggtgattaagagagaattgggggtcgagattgtgtttgtgtgtgagagtgggggtgtttctgagtgtggtaggggtgtgagcacgcatgtctcctgtgggaagagcatgtatgtgtatctggatgaggtgtgagagtttgggtttaactgggttggaggagagtgtggatgtatccagatggtgtgtgaaagagaaagtgtgtaggtacgtttgggctgtgtgtgagacagtgtgtggatgtattgggggtggagtgggtttgaatgtgggtgtatctggatggtaggtgagtgagagcacggatatatttgggtgatggagtgtgtagtaaggtatgtctggatggcgtgtggtgagagctttggttgtatctgggtggagagtgcaggcgtatacgtacttgggtgtggatgtgaatgtgtataactggatgggttgtgtaaaagagagttgggggcacagctgagtgggaagtgtgtgtatggagtgtgggtgcttgtgggtggtgtggaggagatgagagcatgggtggatctggggagtggggcgtgtgcagaggtgcactggatggcatgtgtgagagttggatatgtccaggtgggttgtgtgtggatgtagttatacctgggtggtgcatgtggctttgagtggatctccatggtctatatgggatgaatctggatgatgatatatgagagggtggatgtgtctgcatggggctgtgagagtggggctgtatttggagtgtgcgtgtgctgtaagagtggggctgtatttggagtgtgtgtgtgtgtgtgtgtgtgt

SEQ ID NO: 137336 - DNA, 1008 bp, Homo sapiens
ggcaacagcgagactcaaaaaaaaaaaatctgaaaaatgagaagcattcacaaagaaatgttgccatgtttcttttacctcattattattattattactattatttttaccaaatctctacacatttgggtttaaaacaacacggaagggtgtactgatcccagttccttacagaaagctgaaaggcaggtgggaaatgtcttggatttaattacattcatctggcataatttactgtggaaatgagacctatagacaaacttacaggtgagggctcctcagtaaatgaatctcagagttttccaaacaaactgctgttgtaaacagcagcatctgtccacagacttatggagtttccacagtatttcaaagtattcatgtatcactttgaatatttcaaacttagtttatgttggtgcttcttgtacttctcttcaagtttctaactagtactgtaaactatgcaatgtcaacacccatagatgcatgggtagaaaatgaaaacctttctgattgaacatctaagttagtgtcatctcaatgccctttgacctgtcaccagtgtatctcctaacagcaataattgaacatggcccctttcctattccctttacctcattggtcttaaaaatagtgtacacaatttccctgcacaccgctaacctgtgagattctactgggaggggcatcttagctttacttgttaatcatacaaccctgtcactagccggttgagctccagctaaaaatattctaacccatctcataaaagatcccagtttctcaatttgcactgccagatgctttaaaaattccaaatctttctattgaaggggtcagcagacctctgtgagttctgaaaactgatttttctctgcattcttaagaaagcaacactctggcggggcgcggtggctcacgcctgtaatcccagcactttgggaggtcgaggcgggcggatcacgaggtcaggagatcaagaccatcctggctaacacagtgaaaccc

SEQ ID NO: 137337 - DNA, 1671 bp, Homo sapiens
cgcggcggccggcagccaatggccaggccgagcggacccctgcgtcaggagtgggcggggcttcggcgattggcgcggagggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcagtatccttctaatcgatactccgtaggtcagaagcccgtgacaggaaaggggaaggtgggggagggacagaaaaggtaaagcgggtggaggagagccagaggtgggcatgatccccctatcggaagacggactagactgggtggaagagggatggaaggaggagggcaaaacagcagagaagctggactggagatgatgaagggtggtggagggggggcggacataaaaactggaccacagatgggaaagggggaagaggaggaacatagcattaaaaaaaggatcacagatgataaaaagggggagggtagtaaaggggcacacagcaaaaaaattggaccagagatggtgaaaggaggaggggaggggcacgtagaagatgaactgactcagagaccttgaagagggaggggaatggcacacagcagagaaactgcccagaaagggtgcttgagccatacaaggctctgtaaacctagatttttgcttaagatactaggagaccccaatcctggctggagtgccttgcattggagggaggggggctggagcccctgaaagatcaagagagggagtgtctaggtatagagaaaaaggagttaaatgaaggaaaggggag

SEQ ID NO: 137338 - DNA, 1554 bp, Homo sapiens
catcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggtgagctaatccccccccacccttgtcttccctcttttcttttctcagagcaagcctggccaaggacagggtatcaaggcatgaacacaatctgcttttatggaggaaagaaaaagcattctgagcaactttttaaacaaaggaagtccagtgaacatttaacttaaaaatgtaacaaaaccccaaaaaatcattttagttctaggtgatggatagatggttgtaacagcagaagatgaagagtacacagagataggagacagtgggtggaaaactgaaaaggacacttcacatcgaggtgggggagtggcaaaacacagtgcatttcagcacagtctgtacccggccttggcctttggcgcatttccaggcttgtgttgggagcagagcatgaagtgaacagtgtgctctctgagtccagaaaagggtgcagccagttctacctcaagaatcggggtggggggggtggcgggggaagagctagaggaaaaaggtgacatttgaactggaggatgcattcacactgaggagctttatggagcattctccgtggagtggatcatctgaacaaggacctggaagggtgaaaatgcatcgtaggttgggcagggtttccaaaattatgtcctgaggatcactcaccagatctgaaagctgcttcccacaaaaggtttcagtggtcgtatatgttggacaagtactgcatatagtaataccctcttgtagagtcacattagcaccttaaaggctctgagaataacacgagaattataaaggtgctgagaagtactcagatgggaggtggaaggggcaggaaaatcaactactcttcgggtttttttggctatggggtccctggcaaacttccattgagggcaaggccagggcactaagggaagaggaatgaatgtggagcctcaatctagacatgttcaggtaggagagagaaacagggattctcagttctcttcccctcccacct

SEQ ID NO: 137339 - DNA, 1196 bp, Homo sapiens
actgaaaagaatattgtctctcttggtttctgtcttttctctgtctctgacccttcctccattggatctttctgaatgcttctgtctttctctgttactgtttttcctctttttacccgtctctttctcaaccctaaagaggttagaggtgcatagtttatagcaataagttttacccccgaggacatgagcttagcctggggctccgacctgttctgtgggtaaaaaatggagcctggctttgggttgcttctggtgtcattgaagagagaactctctttgctccccagcctactctgttaaacaggtagagacacccaaagttgggagcaacttagattaaaaaccactttttaatagccccttatcctatataatgttagtcaccacaggaagcccacagatctcctggttatgtctccatacagccctggacatcctattttctatttccatcctgaaatcctttgaccaggccttaaggaactcaccttcagttatcagcaaaattccctccattctcatcctggcttctgaatactccctttattttcttgctatgctttggtcgttctcatacctgttggacccaacattgctttttttttttaataaggtgtattttgaaatgcttcactattctaaaatgaaatggatagaaaatagaatctgtctacacccataattccctgaaaaccaatataatgccctaattgtaatatagagagtagtaaaggaagagtaatatataatattatattatacatatatcgcacatatatatgcaaagactgggatatgactccattagaagacatgatgaaatggtcttacacttaatgatagtgacagctacatgtgtgttgattggtgattcagaagccacaggtagagtgacacagttttcctaaataatgaacaattcttcacaaagttctaaacaaaacaatgtggaagagtttctcagtttatatggtcgttaaatttctggaaaaatcagtatatattaatatccatgatgagaccctcttaatctccctgaccttatctcccaccactctccccccttgctcactctatctacccatgctggccaccttactattacttgaacaccttaggcacacttccgcctcaggggttttgcattccgtgtatctggaatgctctttcctcaaatacccacaaggctcagg

SEQ ID NO: 137340 - DNA, 1996 bp, Homo sapiens
tggtggctctatgtttaactttttttttttctttttgagacagggtctcactctgtcacccagactggaatgcagtgtcccaatcttggctcactgcaacctccacctcctgggctcaagtggtcctcccccttcagcctcctgagtggctgggaccatgggcatgtgccaccacacctggctaatttttgtattttttgtagagatggggttttgccatgttgcccaggctggtcttgaactcctgggctcaagagatctgccctcctcgcctcccaaagtgctgagatgataggtatgagccatggtgccccgccttatgttttgaggagctatcaaactgtttgcaaaagtggctatgccattttacagtcctatcagcagtgtatgaaggttccagtttctccatatcctcatcaacacttttcgtttgtcttttttattatagccatcctagtgagtatgaaagtggtgtctcattgtagttttgattttcatttccctaataactcatgatattgaatgtccttttatatgcttgtatatctttggagaaatgtctattcaaattcttagcccatttttaattggattatgtgtctttttattattgagttgcaggacttctttttttttttttggagacggagtctcactctgtcatccagggtggagtgcagtggtgtgatcttggcttacttcaacctctgcctcctgggttcaagcaattctcctgcctcagcctcctgaatagctgggactacaggcacacaacgacacacctggttaatttttttttttttttttgtattttagtagagatggggtttcctgtgttgcccaggctgatctcgaactcctgagctcaggcagtccacctgcctcggcctcccaaagtgctaagattacaggcatgagcccctgcacctggccagaacttctttatgtatctggatataagtcctttgtcagataatatgtttttttctttttttttttttttttttttgagacagagtctcgctctgtcgcccagggtggagtgcagtggcgcgatctcggctcactgcaagctccgcctcctgggttcacgccattctcctgcctcagcctcccaagtagctgggactacaggcgcccgccaccatgcccagctaattttttgtatttttagtagagacggggtttcaccgtgttagccaggatggtctcgatctcctgacctcgtgatccacccgcctcggcctcccaaagtgctgggattacaggcgtgagccaccgcgcctggccagataatatgaattataaatattttctcccattctgtgggttcttttcattttattgatggtatcttttaatgtacagtaggttttaatttcagtgatgtccagcttacctattttgttgtcacttgggcatttggtgttatatccaataaatcatcgcctaaatcagggtgacaaagatttattcctatgttttcttctaggaattttatcgttttagctcttacatttaggacagtgatccattttgagttatttttgtttcaagacagggtctcgttctgtcacccaggctggagtgcagtggcaccatcacagctcactgcagccttgacctcttaggctcaagtgatccccccacctcagcctcctgagtagctgacactacaagtgtgagccatcacacccagctaatttttatatttttgtagagatgaggtctctgtgtattgcccatgctggtctcgaactcctgggctcaagtgatcctctcacctcagcctcccaaagtgctgggattacagacatactgtacccagcccattttgagttaatatttgtgtatagcgtgagagtaggggtacaggtttattcttctgacatggatatctagttttctgagcaccttttgttgaaaaatattctttttaccattggattgtcttgacgaccttgtcatagaccaggcatagtgacacccatctgta

SEQ ID NO: 137341 - DNA, 1939 bp, Homo sapiens
agctccacaggtcccttgtcctcaatgagcagaagactacaggagctggctactgaagaggctgtccaagtaatagagcaccttcttggccctgcttagcacatttactgcagagctggatgctacttatttgtgctcaccaccttcagggactgcagagagatttgtcagaccctacttcactaagggccaccctctaaggatctccagaagaggctgcccatagagagaagtggcctgcctagggtctccacttcctcaggtcctacccggacacctctagggctgaggggatcagtatctcttcacctgcctgtaatccacataccaagtggaagaatctgcctgctattttttgtttgtttgtttgttttggcgggaagagttttaactactgctgtaactcctttagtagctatggaactgttgaggatttctttttcttcttgagtcgattttggtaagataacagttttctaggagttggtccattttgtctgcattttcaaattcattggcataaagtttcctttttattctgtgctgtgtatgaactgtaacaatgtctcctttttcattactgatattggttatttgtgccttctcactttttttcttgatcaatctcaccagaggtttatctattttattagtcttttcaaagaaccaacttttggctttgttgctcctctctattgtatctttgttttctatttctttaatttctgctcttatcttttttgatctccttccttccacattttttgggtttattctgttgttctttttctaatttaactggacattgagctcattagttttcattctttcccattttctaatttgtgcatttaaggatataatttccctctaactcctgcttctccataagtttagatatgtagtattttcattattgctcagttataagtacttcatttctatcaaggttacttctttgacctgtaagttatatagaaatgtgtttttagatttccaaatgtttggggatttaaaattttatctctttgttattgaaatctgtcttaattgcattatggtcagaggatgtggtttgtgtgacaacaactctgaaattttttagacttgttttatggcttagtatgtgaccaatatttttgaatgcttcctgtgtgctaatttataagaatgtgtgttctctaattgttgaatacagagatctacatatgtctattatcaagtttgtgaactattgttcaatttttacttacctatactgatttttttggtcattatctactgataattgaaagaggtgcgttaatgttcaactgtaatggtggatttggcaatttctccttgtaattctatctcgtttcttgctttatatattttgagggtgttcattaggaatattcaaattaaaaattgttatatattcctgataaatatgtaatgaccctctctattcctgataatgcatttttctttgaaacctattttatcttatattaatgtagtaacacaaacttttcttgttgggatttgtgtggtatataattttccatccttttacttttgagcattttcatgccattatgtttaattatatctcttggaaacaacatataactggaccttttaaaaaatctaatctgattatctcttttggttggcaagtttagtctgtttacatttactgtgatgtatttgggcttgtttctaccatcatacttttttatttctgtttaccatcactaccttttctgtgcttcattttctcttttctcgcctgcttttttagttttgagatttgttttcttattcaatttttttcctccctatttttaaatttttttctattctttctgtggttatccttgatgttttccatatgtgtttaacttataaagtctaaagttaaacaatattttagcccccttcttaaagaatgcag

SEQ ID NO: 137342 - DNA, 2572 bp, Homo sapiens
cctgtgtgccttcctttttcatgaaaggcagcaaatgtttgcagctgaactgtttccccagtttgcttcctgccagtagaattttgggggtccagtggctttttttcattttgtcttgtctgtaatcagctgccaccaagaaatagttccacaggggggcttgggttactgttctgttggcaggttgggcactcagcagtggcttatagccagattggtcgtggtggaagtccatattgtggagtccatgcataacctccatgcctgccaccatggccattttgttcaggaatccattgggcaaagaaaagggtgacagataagaggctgactgacatcacagaacaggacacctacctgtctacttgattgagctcctcttctgcagtggactctctctggtgcttatttatgtgggacgtgaatatctctgcccattccaagagggacagccatatgctcttcctcagaccttgtcaataatatttcagtcctgttatttccaagtccttcaccatttagccgaatcattaaaaactactcatgaaacagtggaaacctatctatacctctgaccagctatgtgaccaggcagttgttctactgggagaatttcccttctcactgtccttcaggatcaaccctaagtagggctgtaacactacagctagctacttcagcagggccagcatatcatgcagggctatgtataaaccaagctggaatagaatattgtatcccttagtcacctggtcacagggaattccccatgaggcttcaggtgtgggtgagagagggatggcagtacagcagttgggagtatgattcacttgctcaggcagcttattcatcatctaggcctgcttgtataactctattctattcggtggtggagtgctactgcacatagataacttcgtggcttgatgagacagttaacacacaactcaccatggggagctcagcttgcctgggtcacttggagtcctatgctcagccattcattcacaaaatagacccacttttccatttttatttttctctgctcctgggactcctgttgtcacgatattgccacctccaattttatcccccatttcttgaatctttaacttgctcttcagctgtagtcctcctcccctttatgccatctatactgtgtagattcgaatagtatatccaagaactggagaaatcaccacaggatttcttctgggcccagtgtaagaaagactcagatcaaaacttcatgtataaccccatcccactctgactgatgggctgcagtggcaatctggatcaccagagattaacattaattcagaaccaatatccagtctatttcaaaggcctggatatttccctgtccccagtgtacaatgactgtggctgcaggtctctgtgaggaaagcaaggagggagattttgccatacacacttgtgaaaagtgtagcaaggtccttcttcagatggaccctccccttcattcaaggggctctggtctatgaactggggaagaggctgggatgccacatttttgaggacaaaatcaggcctccattttccagagtagaagattattggggttatataacaactaggactttatcaggctacctattttggtcctagggaaactatccttaattatccactgttatacaaacctccacaggtcaaacctgattattgctatggctctgctatccattataagaacgagacccaacttctctttggagatgaacctgtcacctccattgaaatcagggagcccattcatgatttctcaccatgaccctcacctgcagaaataaatcactgcaatgctttataatactggtactcattcatgtactagttaaggtaaagctagctcctgggacagaaaaaaattttctgagatttaagacaagtttacttcttgcttctgtagtattccaaaacaggtgttaataattgagtttccctcttctaagtgatgattcagaggcttaggcactttctgtctagaaggtctgccatcttcaaaacatggtcatcattgtatttattgtcatctccatccttaatagccagaagaggaaaagaccatgtgggaggtttctatgagccggatgtagcacacatcacttctcatattccattagccagaactcagacaatgggcatacccaactgtaagggacactgacaaatgtagtctaaatctgtccctaggaggaagaggaaacaagtttaatgaccacttagctagtctctaccacagtgtatttctcaaagtcctgtgaaaggaatgtcaatgtccacatagtcaaaagggtgagttgaatgtgttacatatgactaatcgattccaacattcttattgccctaaacgatggattcccctgcctacactgtaccatggaatttctggcatcttaacctcatttaacacaagctactattgagtagaggttttggtcaatcaatagaacaatttttagaaatactcctagctgcttcaactaacaaagtacatccaggattgctgatgagtgtacccatactgaaaagtttggccctaccc

SEQ ID NO: 137343 - DNA, 1051 bp, Homo sapiens
cccctagaaagggagggggactggctcaggggacaccctccccctcagataaggggctggggagaatgaggtcagggaagcagtgggtatcttctcacctcaaagtcattttctattatagagatatcacctagctgccgagtcctcccaaatgttgccacatccctcaggatggctcctgaatctgcaggtgacaaggggatggaaagagacatcacttctattaaggactttacccaaacccttcaggcccaactgaacccttcttccccttctccttagtgtctccacctgtgccttacctggtgtctgaaacacactaagattaataggtctgtctctcctcccacccccaagctctggagcttctggagggaaggcaaggcccaggcctcagtctgtctccacttccaggccaagggcccgcaatctagcttagaaggaggtaggagcatcagttggggctccacactgtgcatatgactctgtttcctttgcattgcagagtccagtggtacaggataccaccccttgggagtggcgcctggggtctgaggtacatggtcagtgggtccttgaaggggcagacactaaccatgcttcccagaagacctgaaattgtgatgggagaagaggggttaggaagcagaggaacagggttcttgcccctgggcactcacatgaaaggaaggggaacagccccttgtgaacctccacctgggtgctcagctccatgtgaggtatttcacaaagtccccaacagacacaggaaacagacccctaggaaaacaggcctcacctaagcatatcagcctggcagagctgggattttcaccaaatctctgtgaccctaaggcctgtgctagacagaaggggtccaaagtaatcagcctgcaatccggaaatagttcacagtgggagctcagtgttgatctctgctgttggtaggttgggaattcagcagtgctagggccacagtggccttggtaggttagaagttcatattgccgaggtacataacctccacgcctatctctattggttatatatt

SEQ ID NO: 137344 - DNA, 7099 bp, Homo sapiens
gtttctaattctttcccctcataatatgaacatgctctataatttaaaaccttccctctaacctgggcaattggggcaaatttgaaatatgcgagatcaaggtggacaggtgtagtgaggaaaggtgttcagtcttagcatagacatggagggaaggcactgagtttggacctgaaacctcacatgtgatacttcatagcccccacagggtggctggtctacagatgaccctgactgagctccgggcctttctggaccagatgaacaacctgccttgcgccatgcaccagattggggatgtcaaggtgaggacgcttggagtgctgatgagggatcaaggggaccaggggacctgagcagcaggccatgcttggctcctttcaaaagcttaaagtgttcaggcaagacaggacacacgtgtgagaaaagaacaggtgggaggggtgaggcaagggtctagtgacttgtctgttagaaatgggccttgagggtcaggtggcaagggtatgggtataggatacagagtccaggtaaggtttcctggaggaggggtagaggagaaggaggtaacaggggtgcttgttgggcttggaaagtggagggaaattcatgaaggtggaggaggagtgagatggagagggcaacagaccccagggtggtgagcacaagggtttatgtgaggactaatcatagcaatttttagggcagggaggtctcttggtgccctgagaacagagccctctgaaaagttaaataaagcatagattaataattattagttaattaagaatctctcagggtggggcccaggaatctgcattcttaaattccccagggcattctaatgagcagtcagtgttaggaaccccaactgtcttagggcttggagaaggagagctcagcccatgttaggctcctttgccccaaaagcttggagggtaagaagataggtgggacaaggttccatctggtggtggaacccctcagtgggcccagctgaggagtttgttcttcatcctgtgtcctggtagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggtaggtccagctgctgcttcccttccctgccctattccaaacatcaaagttgagtggagacccagaagaggatgcccatgggtggccttaggtatcacgctcctgtgttactgtattgactctcccctcttttgttgtctatcttgtcgtttttttaaaaaacaactctgtatacttaaaggcaaagagaggctgatggagaagcagaaatggacagatagagattatctagaagactagccctacaggctaatgtgcgcatacccagaagcacaagtgacaggcagatgggcagatgttggtagaaagaccccacacagggcagttgacaaactgcagcaacagattacacaatacaggttgtatatgtaggcattgctagcaggccagcagactggcagacaaacagaggtgcaagagctgtggcagaagggatgaagttgggtgcatgcagtcttggggaagcagggactggcagctacccttaggtggaatacaagcaagtaggcccaagtgacagcaggaataacagacacccaaggggcccatgcagatatatctggtggtcaggctgggcttctggtcaggcagaccacatcagactgagcgttctttttttccttacctttaggcagaagcatccaccagccacacttgaggccataatccgtgaagcggaaaacatccctgttcacctgcccaacatccaggctctcaaggaggctcttgctaaggcccgggcctggattgctgatgttgatgagatccaagtgaggaccctgccactcccaccccaggccttcagtccagctgggaagagatggcatatacactgggatgtgctgggttgctgggatgggttgggttggctggagagaggaagggggcatggcatgtagtcaggaggcaagatgtgcctgatgagcagggtgagaggaagagtgtgaggctggcctgaaggaagagagggcactggttaggatgagattggtgggccagggaagcaggtggtatgggactgagcagggcaggggcatggaggagaggagaagaggcaaaccacaacagaaggctgactagatatttggggctgagccagtcagtagatgccggtgttgtgggagagagccaagtggttgttccttaggatgacacctatttttttaatccctcaagactgagcccagttcatctttccagctcagggccaggcacagagtaagcatcaatagcattggcaagttgaactgagctgtctctcgcccttggccttagaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggtgaggcctgggaccttgacctacagcgtctcttaacgcctgccctggcttctgtgagatggctcatgagataacatgggttttgtaggggcaccagggagggaaggaggcgggggatgtaagggaagcccagtcattccctctcttgtctgcctgccccaggttctctgcccatgtgcagatgccggctcagacagcaccaagcgcagccggtggatggagaaggagctggggttgtacaaatctgacacagagctgctggggctgtctgcgcaggacctcagggacccaggctctgtggtaaggagcttcgacacagatggggagaagggcttggtgatgatagagtgtctgagctgggtggccatgagcagaccgcttgtcccctgagcctcagttctcctggtttgggagtgggggtgttaagggggggcccagagaagggaaggggtaggctgctgacccactttgctcctgtcctgggtatggcagatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtgagctactcagcccagctcttgtcctcagattcttgtctcctagcccctaccccagtttaggctcggccctgccccttgttctccaattttcagttttctttggaccagccttcctactccattctgcatctgtccagattcctagactctgctccctgctggcagcctgtgtcttccctcctcctccagaaggcggagggtctcaagtttggggttggcggaggaggaatagggcctggttcttcacttcagttgcccctacctattcttgctctcctccgcaggtccagggcttactggagaatggagacagtgtgaccagtcctgagaaggtagccccggaggagggctcaggtaagagaggtaggtctaggtgtggtgtgggtaggctgttgactgcacatcaccatagtgacccatgtagtcctcagctctgttgtagtggtggggataagaccaagggcagcctctaatgccgcttgttcctgcaacctcctagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggaggtgaggagaggggtcatgggccgggccaggaggtcaggccgagtagggagcccaggcctgaccactggcccacaacctgtctttctgcctgtctgtaatcacagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatctactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctccaaaggctaagaaccattctttgtggtcttgagtgttctgtgtttggagtctgcccatgatacgaggatacaaaggaggaagcaagagtatggaagccctaagccag

SEQ ID NO: 137345 - DNA, 2007 bp, Homo sapiens
agtgctgagatacttgtctgattccatagctgctttatttttgttaatcctcataacaacccaacaaggatgatactgtttatctccatcttactagataatgaaacagacccagagacgttaaatgatttactcatgatcacacagcatataagtggcagagtgggatttgggctcataacttatgcagagattaggtgttaaagttggtatgtaagacaaaaactgttaagagttgacatttcccattaaaatccctaaaattgcccattagatatacacactgggttgtctctcgattactccaatatagccagcttttccttcatttttgaaatggattgctttttctttatctgagcaacagatgaagtcattggattaggtttggaaaccatattgttgggagaaaattattatatctctttaaaccctgaacacaagcacatacggttgaatttctctaagttatatatgtgcacaagtatctcctgcctactaagtggccagcgtggtgcctggaacacagtgggctctgagtaactggaagccgatattgttccccagtacacataactagccaggcctgtcccttggccacttgcactcattgccacctctctggtatcttggtccaccactttcctcacttctcacccacaagaccctttctgctgatctggatcttacctgatttttcttcctctataaaattatctgactcagcgcacactgatcttgccctggtttatctgattccccaagctttgagagtctagactttacaaagggcaggtatgctccctggggtttggcctcttaaaccccatgaccctcagcatagatttgaatctaaagtaggggtcggtggtggctgagatggaggattttgctacctggttctggttatatataacgcataggttaaatgcccttagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtgagcatgggcctttctggaggaagtggggcaagaaggaggatggagagctgggccagacatgctcttgcctgccctcttcctccaggtatcggtataccttggatgagcttcctgccatgctgcataagctgaaggttcgggctgagtcctttgacacctgggccaacaaagtgcgagtggccctggaggtggaggatgggcggaagcgcagtgagtgatgggggggatggagggactccacaggcaagttctattccctttcttctgtactctgacccccttcctctgcctctattcaatactgcctactctttgctgccctcatttttcttccaggccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctgggtatgacagcgtgaggagttagggcacacataaggtgctgaggatccagcaccgaggaaaagtgctgcaaggggtagactgtgaataccatttggcagaatggacatcagcaggaagctgccaggcacaagagtgtgagatggcctggaaggtgttgggggggacaaggagaccaggccacctaaaaaggagaggagagcctctgtgataagaaagctagaagtgtttattttttatcagtacctggaagtggcctgagagagaggctgaggggttttgtgggcagggaagagttgtgggaggcttacgggtaagaacaggacaaagatgtatagacctgatccctgctaacacagctttagagttcacagtagaggatggattgcaaagtgtagctctt

SEQ ID NO: 137346 - DNA, 1032 bp, Homo sapiens
gagagtttgtcatcaccttcccccgtgcttaccacagcggcttcaaccaaggctacaactttgccgaggctgtcaacttttgcactgctgactgggtgagtctagaatgtggtgggatggtggggagaagcaggagggttgtagagaagctggggcatcatggcctccagacttggccacactcaaccttgaacctgcccacagttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaaggtggggagagtaccccagatcaagcaccctattctggtggaagttcggggaggcagaggcagcaccaagaagatgtagcctctactcttggcgtatagtgaaaagaactagatgcatctcgattgaaaaccacataccattctctgctataccctttaccagcaaccttaagtcgatttacttcattgtcagttttcccctctgaaaaatgggattatgataatgcttatctttttggatagttgattgtattaaagataatgtttgcttagtgactgacccatggcaggtactggtatagcagctatttatcattatttacatgacctagcaaaatagactggcatatgaaacctcactgctgattatctaggtgactgtatcaagttacttgatctttcatatctcactttcctactctaaagtgggaataaatacctaacttgcaagatgtaaggttagagtaaggtgatttatatgaaagccatctctctaacattgcctttgcaatgttgcagctgctattattggtaatgttaatacatgaagaaactgattgaaatttggaatgtttctcaggaattgccattttattacatgcagatggtttattaactccagctagggcaataa

SEQ ID NO: 137347 - DNA, 1022 bp, Homo sapiens
aaatggcttagctagatcaccctacagtgaagctcacagttgacaagcttcatctgtgtactcagagcttccatttagctttttaatctcttcctcttaaatataagcaggcagccacagattaacaactgagaggccagtgcggtgcagtggctcacgcctgtaatcccagccaaggtgggtggatcacctgaggtcaggagtttgagaccagcctggccaacatgacaaaaccccgtctctactaaaaatacggcatagtggcgtgtgcctgtaatcccagctgcttggaaggctgaggcaggagaatcacttgaacccgggaggccgaggttgcagtgagccgaaattgcaccacggcactgtagcctgggcgacaaagtgagactctgcgtcaaaaaaaaaaaacaaaaaactgaggaaaccctaaaaaatcccccaaaaaacagaagcaacttggagatacagaggctaggcagggagaaataaacttcaaaagaaaggcatatactgtaaaaatgaatgaagaccagaatactgtttaaaaaaatagcataccgcaaacaaagttatgatagcaaaagtgaaaaatgtaaaaagtgtatgttttccacttttgaaagatgaatagttgaggaaatctcccaaaaagtagagtaaaaagatggaaaagggtagaaaaaattagggaatttttctaggaggttcaatattcaaataggagttatgaaaagaaaatagatgaaaactgagaggatgaaatcattaatgaaatcactcaagaaaatttccctgaactggagaaccgattttccagagtcaatgggcctacccagtacatgagtgaaaagaaattcataccaagatatatcctgtaaatttccatgtcaaacactgagaccagaagaatcctataagctcgagagagagagaaacaggtttcaaatgcttatcaagcattagaaatcagaatggcttcgaacttttcaacagtaacactagaagatcagagcagtgtgcct

SEQ ID NO: 137348 - DNA, 2419 bp, Homo sapiens
catgagccactgtgcttgatttttttttttttttttttttttttttttttgagaaggaatcttgctctgttgccctgggtggagtgcagtggtgcgatctcggctcactgcaacctccatctcctgggttcaagcgattcttccgccttagcctcccgagtagctgagattacaggcgtgcgccaccacatccagctaatttttgtatttttagtagagacggggttgtaccatgttggccaggctgatcttgaactcctgacttcaagtgatctgcccgcctcggtctctcaaactgctgagattataagcgtgagacaccgtgcccagcaaaagaatttaaaagtacctatgtacctagcatatttctcttggacagcactggtctagaatgattttcgctttgttactatatgaattataaccattttttaaagttttattgcggtatgatttgctacataccgtaaaattcacccattttaagtacacaatccagtaaatttatggagttgtgctaccatctctacaatccagttgtagaacatttctaccaccccaaaaagatcccttatacccatttacggtcactcccctttccagcccctagtcccagtcaaccattcatctgttttctgtctatagatttgtcttttctggacagttcataaaaatggaataatatgtggtcatttgtttcttctctcacttagcatgtttttggggttcatccacattgcagcatgtatcagaactttattcctttgatggcccagtaatatacaccagttgatgaaccttttgagttgtttttactttttggctattcacagttgtcatttttaacagctgcagaatgtgaggagaacttttctaaataaccacataggaaatagtaaagtgacattgccagcatcagggtgcagggtgagacagagttatgagcatcaagttctactcctggctctgctacctgaggcttatctgagacttagttttcttgtcgataaaattaaggctggcatagtaagaccccttctaattaattaataataaataaaactaagcctgggactagatcattcagtgaatgttgctagagctcattctttgtgcaaggcctctctggtcaacactcagaaggcaaataacccagtgcctgcgtttgtgtatgcatagctgagtgctggacagaggagtaaataagtggaataaagcattaaaggtgctgcaaaagagcaacaaactaggtcatttaggaagcgggggttatcaggaaaggttttgtaggagcagtgatccctgaaagaagagtaagagtttacctgtcagagctgtggcttaatcatgtgggcatggggattccagtgagaggctctcagctgaggcattacatggtcaaatttgctatttttggaagatagttctggcagttagtaattgaggccagtgcagtaatacaggtaagaaagaaatgctgatgttgcctctaagtagagatagatttgagaagaaaatatgacggaggtgggagctgatgcatggtccaaataaatgtggagatatgtttatgaatgggaagatttgatattgttaggatgttaattctccccaaattaatttagactcctggcagaggaatcattgggttgaagggttcttgatatacattagcaaatttgttttccagagagtagaatgtatttattcccttaccggcactgtacctacttcactgtgtcttcaccaaaattgaatgtttatcttaaaaagctttgtgagacttctcagtaaagatgacagattaagcatacacatggctacttccattctgtactgaaactccacaaaaattacataaagggattttttaacgtgaaaaaaattacagagatggagaatacgagagaggagacaatgataaaattcttgaaactagaaaacagatagatgagaaaactgaaacataagccactactgaggacatcttgagaaccagcccgattcatacctcagaatcccccaaagatttgttatcagtggcaccaggcattctaggggtaaagatggatggggtgaaaataaggattggttcatgtctgtataagaagctgtgagggccgggtgcagtggctcacgcctgtaatcccagcactttgggaggccgaggcgggtggatcatgaggtcaggagattgagaccatcctggctaacacagtgaaaccccgtctctaacaaaaatacaaaaaattagccgggcatggtggcggatgcctgtagtcccagctactcgggaggctgaggcaggagaatggcatgaacccgtgaggcggagcttacaatgagccgagatcacaccactgcactccagcctgggcgacagagcgagacaccgtctcaaaaaaaaaagctgtgagat

SEQ ID NO: 137349 - DNA, 2331 bp, Homo sapiens
cggatcacagggtcaggagtttgagaccagcctggccaacatggtgaaaccccatctctactaaaaatacaaaaattagctgggcgtggtggcgggcacctgtaatcccagctactcgggaagctgaggcaggagaatcgcttgaacctgggaggcggaggttgcagtgagttgagattgtgaccctgcactccagtctgggtgacagagcaagactccgtctcaaaaaaaaaaaaaaaaagaatcacattttagctagagaggaaaaatggtggcagaagaacacaggatagcatattaaagtcagagccatttagataaagtcctaaaggaagaaaagagcatgagatgactccctggaagttgtgagactggaattgagttttgaggaaccaatgaaagaaagtggaaaaggacatttcagtagggaggaactgagcaaaagcatgatggggaatgaaaagactaagccgaagtggtaagagcaaaaggtacagctgtaaagtaaggcctgcctcaggggccttgagtgcagacctagggctcttctccctccctaccccttatattccagttccacttgggaggattcttcacctctttgcctctgttttggtgacatgttctcctttgggtttcaggagtgtaagcggcccccagaagcctttggctttgagcaggctacccgggaatacactctgcagagctttggcgagatggccgactcctttaaagctgactacttcaacatgcccgtgcatgtaggtgatggagggctgaggtagtgttgggctaggatcataggtattgatgccagatggtctcagctcacctggatcagtgggtccagggtgtgatgggccatagtcatctgctacctgtcttcccccagatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggtgagtggatgattcatggttacgtgtcagctgtgtgagcttaggcaaatcatttagtatctgaaaaactcagtatctctgtaagatgaggataattatgcctgtcttatgtagccatgagatttagatgagatgaaagaaaacagtctggtacctggcatgtacaaacatgagatgggttctttcgcctctgtgagcccatttccttatctttaaaatggggataatatctactttgcaaatttgttataaaaattaaatgagaaggtatatgagatcctggctcatccataagtagtgttcagggagtggggtttgtatgcacaggagaaaatgagggcctagttgtgcttccaagaaagggtacattttgatccagagcaggatttttttaacttgcaggtattttggtaggtggatatatcggtaaacttcgtagaaattgaagtgaatacaattgaaattttgtgtgtatgctttttggtggagaggtagggagaaaacctatatgtttcttaagatgtttcaaaaaagtctctgacctcaaaattaaggttccctaggctaaagaaaatgacttaagatctcagttccttagcataaccctcatgccctttttacaaatacctgacctggcaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggtgagtgggaccctggggagccagggaatcaagtcagtgtgggctccctgcatgaccaaggtgtgatttactgtgtgtgtcccttttccacttgtgcaggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagtgagtacccaggcaacagggacaagcggcaggagtgatttagtgatgtcctttgtgatggtggtggtggcggtggttgtcatctgtattctgcccctggcctttcttcattgctgttcttaattgggctacgggtttgactagtctagtagagacccaaaataatagtgattagatgcaccgtatgatggtatgcc

SEQ ID NO: 137350 - DNA, 1617 bp, Homo sapiens
ttcaggataaaggctaagctcctcattaccatgcatgatccagtccctgctgacctctagcctcatcccccagcactgcccacctcactcctctgctatagccacactgaactccttgtaggtatgttcatttttccccgtaagatgcagtatgctctttcatccctatcctttgcacatgttgtttcttcagcctggaagagattccccctgtgctctgccctgttgccatgttttgttttgccttcaggtttcagccagtttcaggtgttaccttttcaatgaagtcctttctcaaggccatccctccttatctccagctgctttgagtgcttccttctctaggctcccacagtgccctttatggaccgctattggcaatttttaatttttatgaacacatgtctctagagtactgtatatacttggaaggataccatgtcttgtctttgtgctagagtccagcgtagttctgaatacgggtttagtaagtgtttattggatgaataaaaatgggaggattcaagactggatgataaaagactgctcttgcagctctacctgcttatttggggagatggtacatacgtgcagttgagctccagacctagcatgactagcctatacagggctgtaaatcattcagccagcaaacacagtggatttccaatggagaacttttgctcttctcccctggcagattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggtaaggcctccccactccacatctgcctcatagggcttccttgccttccttcatctggccttattgagggcagcctcttagctcagccatagtcttaggttttgggtctctgtggtgggattaggctgggcagagctttgggagaaaggagcaggagattcagcctttgcttctgtcctctaagagctcccagaccacctggagaggtaagcatcataattagactatatgtggtgacatataaacagaggctaaattgtgtgttagaaactctgagatatagaagttcagaggagaggaaaatagctaagggtaataatcagggaaaatgtcagaaatgagacttgaaggataggaatattaagaaaaaaatgttctttcaatttctgagtttttgttttgtttttttttttcttttttagaaagtttgaggccgggcgcggtggctcacgcctgtaatcctagcactttgggaggctgaggtgggcggatcgtttgagcccagaagtttgagaccagcctgggcaacatggcgaaaccccgtctctaccaaaaaagatacaaaaattagccaggcatggtggcgcacgcctgttgtcccagctgctcgggaggctgaggtgggaggatcgcttgagcccaggaggcggaggttgcagtgtgccaaaatcatgccactgcactccagcctgggcaacaaaatgagaccctgtcttcaaaaaaaaaaaagacattttggaaaataggcaaattacttg

SEQ ID NO: 137351 - DNA, 1048 bp, Homo sapiens
gccaggcattcttggcactgggaatacaatagagaacaagatggacactgtccctgggctcatcgaagcatgtaatttagcagatcctattagactgccatttgttggtaatgccaaacactgttagctttttcatatgtattgtccctaacccccctcataactataagggaggaggtaatattctcattttacagttgggaaaactgagatatcctgtcttttattcctttctgagagagggccgagggggcagctcacctaccctcagtctccaaaaagcaactctgagttcttggcttagcccatctgtgcctcagccctcagcatgagatcaggtgatatgtagtccgagttactgttcttttaggatgggacagtctgccccagatagcagtcttgattcatttccttctttccttccagccggaacccacagaggaagacattgagaagaatccagagctgaaaaagctacagatctatggggcaggccccaagatgatgggcctgggcctcatggccaaagacaagactctgcggaagaaaggtaaggcctaacaggctggggtggcctcacctggggagaaaagtcagggccctaagtgtcctagacctgtgtttacagccatttttctctctcccagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttgtaaggacccagccctgacttcttaatgctctgcttcttgtcccttcaataagcattcccctgcatggcactggaccagttcgcattaaccacaaaagcgggcctccatgggccctgccctcaggtagctcacttaattggggaaacaaagccaactcatatggaacaaagagcaagaaagggtgatcaagtgctgtcaacatgaagtgctggaagggt

SEQ ID NO: 137352 - DNA, 1026 bp, Homo sapiens
cctagtgatgcttattctctttctacactgctcagggtcagaggtcctggagttatctgtacggctagcttatttgttatgtgacaaagttttaactgatagagaaatcagagaagggagagcttgggctagaaggtgtgggaagagatggcgtctgatttagttggggagatggttggtggaggaagtgactggaagggaggagtgatacaagcaaaggtactgagaattcccaaaatgtgtgctggtgtcagtgctaaagaccagtggaacaggggctgttggtgtgggtcaggtgagtggaccacagctttggatgccattgggtgagggtagagggaagttattgcttttgcgggctggagtccatgtcctgacccttaccccttacctgtccccagcagtgtaacacacgtccatttgataatgaggagaaggacaaggaatacaaaccccacagcatccccctacgacagtctgtgcagccttccaagttcaacagctatggccggcgggccaagagactgcagcctgatgtgagtactccccttcttcgaacttagagctttgaggtggagggagtcctctccttccttctggctaaggctgtgttccctgttccattatcccttcttttgttctctgagttcttctgagcattagtgtgcctctctctggcttcactcttgcttttttctcccctctcagctgagctgctgagctgggtcttgatctgtttgtgcaacctcttttgtatgtctgctcttcttgcctgttttgttcctttccggacttactctgctcatagaagtagaactcttctttctctttatacctgtatcttttgttttgttttgttttgaggcatagggtcttgctatgtcgcccagactggagtacagtggctattcacaggcttgatcataatgcactataatcttgaactcctaggcttgagtgatcctctcacctcagcctctggagtagctaggactacaggtgtgtaccactgttcccagctccttg

SEQ ID NO: 137353 - DNA, 2193 bp, Homo sapiens
ctgaatacttataccctaaaagttcacttgtgttctagaccagagttcctcagcctcggcactattaacattttgggaagctaaggtgggaggattgcttgagctcaggagttcaagaccagtttgggcaacatagcaagaccccatctcagaaaagaaaaatatatcttgtcaggtttataggggtacagcttgggcaagatgttgcctagcatgacacaagggcaggttttctgtagagggagtgctgactaataagaaggagcagggatgaggccaacttcagaaagctaaggggctgaggttgaaggagcacttccttgccctttgagagttctcacagccaaggaactgtaggttgtttctttctacaaatagaccttagtttttctcaactatgaaatggaaagagctgtctttgttccccctaatgggatcagggcaaggtagtgaatggtaatgactatctagttcttccaagaaccaggctctctgactggagtgaggaggttgtagacttggggcctatgggagtccttcttggttactgagatttcagggaagcatcatacatatcttgtttctagtctccttggcccacattgggtcctgggttggccaggtgctagtgctactctgatataccatctcttagttctaggccattctgtctatagttatagcatgcactttcaccctttagccaccatggaacaagtttggtggtacataaggaggtgcatgtgcctttttggagcttgctttctctgaaacatgcctagagcttagatataattctgaaatctgcagaggatcttcactggtcccctcattaagtctacccctctggggtaagtggactgtgcagttattttccttttataattattagtaaaaggaaaaaggagtccacagtggaactgatttgctcaaggcagcatagcaaatcagtagcagagggagagccaaagctcaaattatttggcaccaaaatatcttgatgcttgctgtgtgtcctaactcctctgagcctctgtttcctcatctgtataggagatgataatactcacatgaccttgtcagggagattagaggacatatctaaagcttttggcagttgtgaccctctctattgggaccttgggcttctctgattgactggaaggtgacaaatgagagagaggtggctgggtgcagtggtgcagtggcttgtgcctgtgatcccagctctttgggaggccgaagtggatggattgcttgagcttaggagtttgagaccagcctggtaacatggtgaaacttcattgctacaaaaaatacaaaattagccgggcgtggtggcgtgcgcctatagttccagctactcaggaggctgaggcaggaggatcacttgagcccaggaggtcaagtctacagtcagccgtgattgcaccactccattccagcttgggcgacagagcaagaccgtctcaaaaaaacaaaaacgaaagaaatgagagtgaggtggggctaagcactgcctagagtctgggatccggttcattgggagaaaccctgggtagtgaaagtgtggagtgctgtattcctctgttctcccctaagactggacccaaagatagtggtcagtgggagggggtggccagcctctttgagccatttcttcttcaggcccagacgagagtgaaactgaactacttggaccagattgccaaattctgggaaatccagggctcctccttaaagattcccaatgtagaacggcggatcttggacctctacagtctcagcaaagtaagaacaggtttttgtcaagcacccctcccaccaaaccccaatatccttgatactctgggggcccccttagtttggatattagatctttaggctgcaatggaaggggcacagcttggtagcacacaagctgtcatcagaacatcttggaatcttttgctgcaatttgaggttgggataaggggatagcccccagtgaagtgagggactagagttgccctcattgcccttttgccctttctacaggcctactccctcacatataaatacacgtggcacatccatgtcttttcctacttgttttttcagattgtggtggaggaaggtggttatgaagctatctgcaaggaccgtcggtgggctcgggtagcccagcgcctcaactatccaccaggcaaaaat

SEQ ID NO: 137354 - DNA, 1011 bp, Homo sapiens
aggtgtggtcagccttagatgtcaggtcataacggtgactcctttgaataacattttcatttgaaaactagttttaattttccatattggtctggcaaggaagccagggctagagttcatattcccacctcacagatgagaaaacaggttcagaaagctaaaatctcatagctagtaagtagcggatctagaacatgaacccatatcttctgactctagatcctgtgtgctttccagtactcccaggcctgtgtgtcctacagcacgtgcctaggggataaggaattaatgtgggtgtggagaaggtttagggtcaacaaaacagaggctccatctcttaatttcttgaaatcctggcactgtactgttgggtgggactcaggagaagtttcctagggcatgtgcatggggccttgggtgcagacttgaggggctgctagactcttgtgagttctggggggaggtgggggtgggtggttgggtaggatgtttgcaggttaaagggtctggagtggctagaggtttgggaaggtgccagtgggattccgagctgcttttggtgacttccggtcttacactatgctgagataactcaagtccctttcccctctctaccctctcaggactggcagccaccctttgctgtggaagtggacaacttcaggtttaccccccgaatccagaggctgaatgagctagaggtgagaagactaggagctggtggtggggttgggagaatgtatacctgagttctaatcccacttcccttatagtttctctggctgaggtactttacctagctaggcctttattctctcttctgtgaaattgcattactttagtgtgcccagggcgtggaagaagctttagagctctaaatataaccaagagccaggggcatttagcatttgtgatttgatagcccaaaggctggggacatatatccctttctcacaaaggtttgctacttctgaaactcccctgtaaactagcctaccctagctgagtcaa

SEQ ID NO: 137355 - DNA, 3555 bp, Homo sapiens
cccgcgggccagcataaggggtcctttgcaatcaggctcccagagccgccttccgcggcccataccgttaagaccagggagaagggacagagaacactggtgcggggctagcgacctggttgaggtctgcgggggagtgccggtttgactccaccacccacggacaccagctcctcttccggtctccataacgcgcatgcgcatcactggcctttaaacgtgcaccgccggtccatccggaaagacgatccggcaaactaattacaatcttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggtaagccccggggccggttttcgccggcggcgagacggaatgaagcagtaggatagccagcggcgaagtctggggcggagggcagctcgaggtggggagagggggtggctgggaccgttgtggttgcggcgcggatcggaaaaagggtgttgggccaggggtcctctcgtggtgtgaggcccacaggtgacctggagtcagagatccacccccaccccggcccttcagaatcactccgggtttaagacagggattcctagtgggccggagggagttcacagagaggcaccccgcacatctcttagcccgggccacctaggtcgaggctgtaaaaataagacgtttctccaatctgttgtcatcacttcctttaaggcaggcagcatagtatagtattaatagaaagatcgcagtcctgaagggagacagacttgagttcaaaactccactttgaagctgagcagctgtgtgaccttgggaaagtagaagtaatctctctgagcccgtgaaatggatcccagaaatggttatttagaggattgaattaaactaggtagcgtctgtatgtagtacgcactagataagtggtaattattgtgactgtgagggtgtttgatgtggtcattggtttattcctatgtaggttgactcatatttactcataccttgccaggccaattcatctatgataatatcctggcctgctggaccagtcaggaaatcagtctcacagggattgctctgtctcccttgaggtgggttcagggaattgtcctcttcttttcctcgttgaaggcaatgtcaaggccttttctgcacatcatcccgcagacttgacttcctatggagatgtttggaccggtcagcttggtggtggggtgtgagtccttctcagaagatttctactctcctctggtccaggatgtaggagatcccagaggatagggcactcttgggcccgcagaacagaatggagccatggaattctgtcccttttggaacatgattgccaggggtcagcaacaaaggccatagctttcctcctaggcctggcttcaggctagaagtctcccaagggctagggcaagctgctgccttgctgatatggtggaaaagtgatgataatgttcagtgatcagttgggattccaagggcagaaattgagctttgctggaaaagggtgtttttgagtgggtgtctcctggctgaaatggaataggaagcttcattcccacctgaggagggcaccacaggcctccttatccaacttggtgctttctggtgctcagccacagatctaggatggtttcagatagatcctctaggaggtgttgggtaagcgaatttcttccttcttggagtctggccacagatttctgaggtatccttgtccatggtgagggagtggcagtgggtagagggtcaggaaggctagtggaagggagaggcaggagtcctgggcagcctcaaggaggcactccctgaagtggttgggcaagcctgtgggaaaaagaggcatagctgacgtagggggtagttgaggcctgaattccttttttctatcttggactgacttaggcaggctggccttgtgtaggtgttgttaccctgctttggggcatcaggaaggggaagagtgacatgtcccaggtgtgcatggccagcaggaggccgtccttttcactgctcaacagtgtgcttctctctaatccaggatacctggctctctggtttggttttgttttttccttctctatggcagctcctaggccacctttaggcagctggccttcttctggttgaagtttgaagtactcgctcaagtgatgcttgggcccagggtgggaacctgtatatgggtgggtacctgggaattggaggtttgctggaggaaggatggtttggggcctgaattgctgggcaggtgactgctacgcttgggaaagatgggtgggaggagagtgtgggtaccctgagtagacccagtggagtttggaaggatcttgctttcttcatcaggtagccagccttttttttatcaccacatcccagtaataccaacatacatttggcatacagtagtctggagatgaaggcaggcggtttgcagggccttcccaggtatctgttgcatccatggctcctgccgtagcattccagggctgccatttcctgtcaggtgcttgatgttgcactgattgtctagaacttgattcagcaggaaagaagggtgcccggagttttgggtttgagcacctttttagctgggttacctgtgctgaggggagtgccctatcctgatgagaggcaagagggcatggggagcttgtctggatttgagccataccattttggcctgcctgtttttttttttttttgtccctgcttactgagccccagatgtttgccacctgctttggctggtaggggcaggggagtgtggtctgtgtatgcatgcaaaatatgagtcctctagcccattttctaaaagtgtgtgtgcagaagaggtcaacagtttttcttctctttcactgtctctcccccccgcccacgtgtatgcatgtatgtatgaacattgatgtctggtgtagtgcaaaggccttg

SEQ ID NO: 137356 - DNA, 1044 bp, Homo sapiens
tccccaccttccctttttagaggggaggtgatatggtgtagaaagagccctagtctgggaaacaggagacctggccccctcagtcggcctttggctagactcactgcatagccctgggcaaggtgcattcctcccctgggcttccatttttccacctaccactagcagaatgtgtatgtaagaggtgttgggggcagggtggtgtgctggacccttcagtgactgtgactaagctctttctaggtgcctggtcttctgccaggtgtttaggagtgaggtgggagtgtgacatttgattagaaaataattggaaaatattagatgtaattggaaaacattagatgtaattggaagccattacttgaatgccttacatctttatagcttattaaacactgccacctatatttaattcttacaataactcagcaaggcaggcagtagtgttcctattttgtagataaggaaccaaggcttggagaagcaaaaggaattgtccaaagtcatacaactgggaagtgatggatctgagactcctatggcatcagtcccttccaaattttaaccttgtggggtcctaaggttctggggttctgaatatgggatagctgtgacccagattttggcccagctccctggaaatctagggggcaccttgtctacagaaacactcagagaaagttggtgatacctgcctgagtgggatgtgggacgtggaacaaagtaacctcttcacttcttccctactctgagggtctgtgactcagagggaaggtgctcagccctctcctcggttcttgctgggaatgtcaagcctggcatagagcaggctctcattagatactgattttctttcaattgtgatgtggctccagtgaagggggatgttgggttgaagataccttgggattttgaagctccttgaaatgggcaagtggcttcttctccctgggcctcagttttctcacttgtgccatgatgggattggatcaaattatgtatttgacttcgttggtcctctgaggccggacttagttgggccca

SEQ ID NO: 137357 - DNA, 1051 bp, Homo sapiens
ctggaggcgggattcaggagggcttcttagtggtggcatatgacctgaatcttgacggaactaggatgtgggggaatttctcagattgcagatggcggagacgatggggattgcatttcaagtggtaggtactgtatgagcagttttggaggtagaaagcagaggagcatttgggaaaagcaggatgtgggccaggctggaatgatgggtggatggaatagggggctggcagccaaccctgaagtatggcttaatgtttaagagtgtgggctctggagtcagactgcctggatttgaatcctggctctatcattagtagctgtgtgaccatagatatgttacttaacctctctgggcctcagtttctttatgtgtaaaatgaagataaattacagtacctacctcatacggttgtcttgaagagcaagcaagttattcagtgtgaagtggtaagaatggtacctaaatgtgctaaatggtctataaatattagctgttgtatcttggagaagcctcaaatgccagaataagggacttgggctatctcttctgagcagtggaagttatagatgatggttcatgcatacaggagacagttgatcaaaactgggcttgagccgtgtgctgggaggggaggtttgagagattaatgggcaagatcctgcagtcctggcagggaggagaggaacatcttggatgccgggggtgggctgagctggggctgaaccctggagtgggggtgatgtcagggccaccgccccaggcccaggaggagagagaatttggggtggagagcgagcgatgggtgggagctctccccagggcggagccgagctccacagcgctgcagcccgggaccgggcctcgtgggcgcagccttcacaccacatccagcccccagtgcaaagcgctctgctgcaaggctggcaggcctgttgcagttccagctcctgcactggtagggtcccccccagtacctaccccagcccatttctgccctttgcctttgcctctgccgaataggggctggggagtaccccttcacctgttt

SEQ ID NO: 137358 - DNA, 1053 bp, Homo sapiens
gaaagctgtgtttaagccagtcattcaaggtccatgaggattctgagagttagagatgggggaggaggtgctgacagtgtccgcaaaggcctggaggtgagcaaggtgaaatcagacattggagggtgcagaggtcaggcttacctcaagcagctgtctgaagagtataggctttttattttattttattttttttttggtaggcagttggagagccatgaacagttcttgaataggaaaagatgaaaagtgacatgatcaaattagcgttttagaagggaaatgagggaggaggctatgcagtaatccaagggagagagaagccaaggtcgtgggcatagagccgaggagatggatttgagaggtgatcaggaggaagagaggactggagtcagagactgaagaggtaaccggggagagaggaggaggtggagatgacagaggctggagttcgcagtaagttcaagtgttcatgcctggcactggattcattcattcactgaatatttattgaatgccaggcactgtgttaggcactaggggtttagcactgaacagaacagatgcctgtcctgatggatcttacagtgagtgagacagaaaaataaataaacaactaaatgtctagagtgtatctgatgtcgataagtgctatgaagaaaaagctggggtgataaggtagagaatgttggggtgccttttgagagggagggcctctctgatgaggcagtatttgagcagaggcttgaaggaggtaagagagtgagccgtgtacctctcagggacgatgttccagatagaaggaaccgcaggtgtaaaggccccgaggcaagagtgtgtttggtctgtttggggagcagcagggagaccagtgtgatggggaaaaggctgaagaaggagtgagaggagtagaagatgagatggtaggggcaacatcacagtctatcttttagagctatttaggaggtagagtccacaataattggtgactgacttgctaagagggcaggaagaatctagggtgactccaaggtatgttttgggctcaggtga

SEQ ID NO: 137359 - DNA, 1155 bp, Homo sapiens
agtgaaaacatgttatgaacaccctgtcatcatttcaaaattactggcctttttccttggtcccatttccttgcttttattaattcatttccctcctcctttataccttgtccctgtatccagctgttcagattttgtttagatccttttaataattagctcagataccacatcattcattcagcaaggattctgtcttgcctgctttagattaggccttgtgctgacctttggtggaatattggaatgaattgtatctgatcctgctctcatggagctgaagtctagaagggagaaaggcacatagacaatgacaccgtagtgtgatttgggatgggacagaagtaggcccagaaggctgccagatgaggggcaattaaccccatctgggaaggcttcctactggaggggacgtttgtactgagtcttggaagagtgctagctttccttcatccccttcctccaccagaaatggtcttgttcactctttggcccttccaagcaggatgacgtcataggggaaaaatagtggagtcagtacctttattcaagtccgagttctgccacttaccaactcggtgactctgggcaagtcatttatcctctgagcctctgtttcctcatctatgtaatgcggctaatgccaacttacctcttagggctgtctttaggattggagataatgcatgtaaggctcctgggtgactgtcagctctagaagaggagggactacctgtgtcttgttttcctcatagccaactgtgtagcattgaattggattcgatctcaaagctgtgtgtattagacggttctggagcaaagaatgggcctgaccatagcagggctttgggatgagaaggctgagaggagtacagggtacatgggttgcatcataagaagagagaaccaggtgcctggtcttgccttatataaaggtgatgcaggagggaaaataagagtaggcgttcctgggaaagggattccaagtagggagttctggccctggttcttggtcctcttctactgataccatctcctaatctcacagttcagagcagtgaggcatggtggaccactacttgccatggcattcatggcaatttcagtcccaactttgtcactcactagctagctgaccttgaccaactcacttca

SEQ ID NO: 137360 - DNA, 1013 bp, Homo sapiens
gaggacagaagtctagaggagtcagagctggattttgacagtgggagagaggaggaggtaactttccaggaagctaaagaagggcaagaaggggtaagaggtttctcttctcctccccttcctctctgtgttctgccgccgcctggcccagccccaggaagtgggtgacccctaagctggctgagtgcctggttggcaccgaaataaacttgccttctctctcttcccctccccttgcctctgtcccctctgtcctggctttaattagcagccctggggatgagtcacttggcagctggggagggaggctgcacagagctcagtgaagcttcgactcctgccctgagccttacgggcagcacctctgtgtttatgcatgtgggtgtgcactgctgcatggcagcgtggctgtgaagagcaaagtgcaacactgcatgctggcgcgtggccctgcatgtcagggggtctgcagagaaccatatctggttgctgctgcgtttgttgctgtgtgccactgaatgtcagtgtgtgtgagcgtgtggctggagcgtgtggctgtggttgcaagtgtcagggaaccagggagcttctgggtgaacaaacacaaacgctggacaattgcattcacccctctctacctaagtgttctttatgcgattttgcttacacaaaccctgcacttacattcccaattttcacttgtcttagtctgggtacactttgttgtgaggaacggaagcccactcaagctagctcaagaataaagggctaatgaggggactattgtgaggctacatttcacagaatctaagaacagttaatgaaaaacagccaggcctcacaccaactggaagtgggaccaggaagtcgaggaccaaggttgctgtctcgctgtctgcatctcctgggcccatgtctcatctttctccatctctcatggcttgcctggtccctgtcatctctttttctttctttctttctttttctttttcttttttttttttttttttgag

SEQ ID NO: 137361 - DNA, 1046 bp, Homo sapiens
agtgcagtgttgcgaacatagcttactcaagtgagttcaggagtttgaggctgcagtgagcaataattgcaaaaaaggaacaccaggctggcccttctagttgctatccgcccaattcttttaagcagagacggggtctctctgtgttgcccagactggtctcaaactcctgggctcaagcggtcctccctccttggcgtcccaaagtgctgagccaccacgcccggcccaacgtggtattcttgacagctagggcagtgtatggtctaccacatgctgtcgtctgcttgcagtgggatgtcagcatgctccccgcaggggctaaggccactgagagacagcacgtgagacagtgagcccagggagaggctcagggaagtctctcctttggggtcttgggtacttttcccagggggtgtctctccttcccaggagggaaaaccatttatcttccctcccactgtgttgtgagcattatcttcgtgtgggaggaaatggtaatgttgaatttaatgagaatgagagtcttgcttctctatctagatctggggcaagaatggggttgttatcatctacaaacatttcttggctgtgtgcacagcgcaggaggggccacgaggctgagcaaacactgcactcttagcgcttgcagaacccctgctcccctccatccagggagacagggttgcaggcctagccatgccatagaggcaacactcaggacaaaatgagtggcaagaatggtgaggagtggaagttctcagaggaaggagggatcaggccaggccaggctgctgtttgagtacctgggcggtgggtgagggatgaggggtatggaaggaatgtgagtggtcccttcatggaggtggcagctgggaggaagacgtcagaccagacttgctgcctgccctttcctcatctgtcccacccctgcctaccaaggtctctgaatttgctgggcgcagagtaaaggcctggagcatggggaagaggccacacgtgtaccgagtgagtctcagccttctgccaggccccacgctatgtga

SEQ ID NO: 137362 - DNA, 1039 bp, Homo sapiens
aaaaattagccgggtgtggtggcgtgcgcctgtaatcctagctactcgggaggctgaggtgggagaattgcttgaacccagcactccatcctggacaacagagtaagactccatctcaaaaaaaaaaaaaaaaaaacagtacttgaaaaaagtacatttgccaggcgcagtggctcaccctataatcccagcactttgggaggccagggcgggtggatcacctgaggtcaagagttcgagaccagcctggccaacatggcgaaactctgtctctactaaaaatacaaaaattagccgggcatggtaccgcatgcctgtaatcccagttattagggaggctgaggcagaagacttgcttgagcccagggggcggaggttgccgtgagccaagatcacgccactgcactccagcctgggcgacagagcaaggctccatctcaaaaaaaaaaaaaaaaaaaaagtacatttaattgtcataatcagaggcataaatgaagactcgtaggaacccccaaggggagagagagttctaccaggggacaaggaagacttttggaggaggtggaatttgaggtgagcctttttaaaagggaggattccaactggtggagataaggaggaaaggctttccaggcctgggggacataaaaacaagaaggtgggaataaatatgccctgtttgggctaacaaatattccattttgactaaagcaaagaggcttcacctaagggagaagcaggaagagagactgcagggtttcccaaactttattatattctgctacagtaggtctggagggataagggaatttggggggaggagggttgtgggcaggagtgtcctttttaaaattttttttctcattttaaaatagaagtaatccatgtaccttatttagaaaactcaaatcagtaaagtcaaatcactacagacggactcgtgaaaagcaaaagtctactgccccacacatccccacccccactctcactttttgccaccacttttagttatttattctgatttttatctccataccta

SEQ ID NO: 137363 - DNA, 1025 bp, Homo sapiens
ggtaggaattagccagttgaggaagtagaaggaatttccagatattggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtct

SEQ ID NO: 137364 - DNA, 1050 bp, Homo sapiens
attacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcc

SEQ ID NO: 137365 - DNA, 1691 bp, Homo sapiens
acacccagagagaaccattgactgggctttgggcaggtatgtagggaggagggtttgaggcccctggtcctggggcactagacccctcttaattctctccttacaattttatttttctttttctccctcctccttcagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttg

SEQ ID NO: 137366 - DNA, 1585 bp, Homo sapiens
ctggtggaaggaaccgagctggagaagaagaacctgccctccgtataggagcaggcgcccaggccacactcagtcagtcatctttcggtgggggccttggcacaggggccaggcccttcttgacattgctgggcctggggcttacaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatggtaagatttacccttctacttgggcctacgatgaggacaagaggctaagggtatgccacgggcctgctatacatcacagcagttcctgttctgacatgttttcttacttaaaactctcaggagccctaaacagtaggggttattacacctgctttatagaacggaaaattgctgaggttcccggagagtaaatgacctgttcaaggtcacacagctggttgctggtagaacacagggaggaatccatatttgtgtggctccaggcccctgtttcttgctctgcattgtatccagtggccagtccactggatacagatccttctgggaccctcctcaggcattcctctctctcagtgggatgttcctgctctggattgtcatttgcaggtccttcttgccagggcactgaggggtctcctgtctttctttctggcagagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggtaggctggagccccttacccaaccagctgctaccatcctcagttgtccttccctctaggcttcctgtccctatctccatccagtctcagatacagatcctgacccatctgccttcccctaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacaggtaaggctgatcccctagggcagttgacgaagagactgaactgaggccaccagaggctctggggcccaaggatacacagagatctgcgaaggtgatggtttggtggaatctggattgcatccctgtttcactatctactgcagcatatctggctttggtttttctggacctgtcttccccatccaccctcatctgctcagcatgtcctcaccggcctctgcatgtatttagttccgcctccaggcttttgctcacgaggttgctggctaataatccctttccatgtaaatctagcttgatcatcacctttcaccccttcacccttcctcattctcctcccctttaggaagccctccttgatcactgtggcataccctgaccttcccctcctgaatgccagtagtacttgagtctga

SEQ ID NO: 137367 - DNA, 1004 bp, Homo sapiens
atcctggggccgggcgcggtggctcacacctgtaatcccaagcactttgggaggcctaggcgggcggatcacgaggtcaggaggtcaagaccatcctggctaacacggtgaaaccccgtctctactaaaaatacaaaaaaaaaattagccgggcatggtggcgggttcctgtagtcccagctattcgggaggctgaggcaggagaatggcgtgaaactgggaggcggaggttgcagtgagcctagagcgcgccactgcactccagcttgggcgacagaggaagactccgtctcaaaaaaaaaaacttaaaaaaaaaaaaaaaaacctattctggagaccactccaaagtagtgtatagagatcttcataagggctttctaaaatgtacataagtttatgtccttcttattcttgaaatcattcactggtacctcacctttctcaggataaagtctaaaccttataaggccctttataatctggcttctacttgtctatctagcatcttctctttctgtgccctccaacacacttgtacgcatgcacatacacacacaattgctactactgccatatatatatatatattttttttagctttcgaagtttattgaagttgattactcttttttttttgagacaaggtcttgcactgtcatccaggttggagtgcagtggcaccatcatggttcactgcagcctcgatctcctgtgcctaaacagtcttctcacgttagcctcccaaggagctgggaccacaggcatgtgccaccacgtctggctaatttttttatttttgtagagacggagtctccctattttgcccaggctggtctcaaattcctattctcaagtgattttcctgacaggctcccaaaatgctgggattaaaggcatgagccaccattcctggcttgctttctcttttgaattattttcagtttgatgaacggaccatgagcaacctcccctggctatttttttgtgatgctcccaactgcata

SEQ ID NO: 137368 - DNA, 1458 bp, Homo sapiens
tctgtatttagatttcctaaaatttacaattgaaaaaggagacccacatacccaagttgttccaaatatccatcaaagttttccagtaactgaattgaatatcaggttttcaatttaaatgaactaaaatttcataaaattaagattttatctcctcagttgcactagccaaatatcacgtgctaagtagccacatgtggctactggcaaccggattggacagcacagtggcttggttagattcagattttggggttcgcttgtttgttgtggctacggctccttcacagctggtggtgttacttccatcagaaggtacttaatgtccattagtggctctttttgtgtggtttgcagccatgcttcttattgcatagatccattaattagtcaggggttgcaaaatggtgaccttactctatcatttctgtgtttactggctggaatactataaagagagacttcctctcatcatttatttggttattctgagatacagtttgtataggaaaggcaggctatatatgcttgatttttttcccccctttatcagtttataaaataaggaattgcttccttggctttctcaagatttgtccactgagttctcatatcattatgaatttaaatatatttggtgtctttcagtctgttgtggttattatccttcttggtgctcaggttgtcccatctttggccaatggtgactcattcagtttggcttctgaatcatttcaacacaaccctggtagtctttgatatctcccttgctttccaatatgtccagattcatcctccccattttccacccagacctggaatccactatttctccaggaagctctgacttcctttagtgggaaatgctattatttagcaactaccatctggatattggagtgttcatgattgctgagtttattagtgcttctagaacttttcaatagattgggctattaaatgcggtttttttgttgaaggaaaaatgcatcatgagttcatattgatactttgaattgaaattgtaatttttagtttaacgtcattgattttctttttgagtcttccagttattgttgctgaaaatctcagttcctagcaacactaacataataacacatttactttatcctactctgtatatactagtttgaaaaatcacaataagatattattagtaaaagggccaggcgcagtggctcacgcctgtaatcccagcactttgggaggccgaggtgggtggatcacaaggtcaggagatggagaccatcctggctaacatggtgaaacgccatctctactaagaatacaaaaaattagccgggcgtggtggcaggcgcctgtagtcctagctactcgggaggctgaggcagaagaatggtgtgaacctgggaggcagaggttgcagtgagctgaggtcgcaccgctgcactccagcctgggcgacagaacaagact

SEQ ID NO: 137369 - DNA, 1103 bp, Homo sapiens
gtggttcacagagaatttccagtatctatgcacgagaggccctcattgagattgactacggtgatctgtgtgaggatctgaaggtgaggatcaaccacaggggtgtggtgggggtgggggttgggtgggagtgggactatcttcctagttgtccagagaggaggtcagcccatctgggggctctgtgaagaccatggctggaaagaggggaaagctggcaagggtgggaggattcagttgtgaggcaggatctccacctcatatattcaaacagacatatgcacattccctaccccataccccaagttgcccctgcccttgcctgctatcagtcttccccttccatgtgtgtatataactaagctaagcctaggtccacacagagaagagacttcagtacagtgaacagattgacctcaggtgttcctcagggctctttcctcctcacttggcattctttcatcctggatatcactttacttccgtggcttccgctgcaatctctatgctaggtcccacaggtacctcaagccctagccttcctccccatatttacccatctcctcagtgccactcacatgctcagccagaaatttgagcctcatccttgacttctccctctttcactttacataatcaattaattaccaagcaccaagccctatggattctgcctcctaaatatcttttttttttttttttttttttgagacggagtttcactcttgttgcccaggctggagtgcagtggcatgatctcgactcactgctgcaacctctgcctcccaggttcaagcgattctcctgcctcagcctcccaagtagctgagattacaggtgcccgccatcatgcccagctaatttttagtagaggcggggttctaccatgttggtcaggctggtcttgaactcctgacctcaggtgatctgcctaccttggcctcccaaagtgctgagattacaggtgtgagccactgtgcccggccctaaatatctattgaattctggtttttgtttccactgtctaatgcaggccactttcatctcacatagccaactacaggagcctcctaaatagtttatgatgtgtttcaatcatcatt

SEQ ID NO: 137370 - DNA, 1290 bp, Homo sapiens
tacatatgtgtattcatagaaaatgcacagtattgtttgtgtgggtttaaaaaaaaaaaaacaacaacaaatgttaccatactgcacatgacaaagttttgatgtagaaaaaaatgctcaaatataacattaagtcagaatacagagttttaattacagtctagtctcaactatgtaaaactgtctgtaaatcaaatgctgaaagaaaatgtgctagaatgttaattgattatctagctgatgagattgtgagtgattccccacttaatactttctctatacttttctacatatattagataacttgtaaaattggggtgtgtgggagaggacaaccaaattttaaaaagataggaggctgaggggtgatgggggtgtgaaagcaaagctcattgacgagtgactccaataaactgcctagtaggaagggtgggagcaggagaatatcccagggtaagatggggaaagtcttcacctattgtcctgttcccactgctgggaccaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaagtgagtgggttcaggcctggggtgggaggacgtagatagagcaggcagcctgccagatttgggtctcacctagcccctggaccttttttagggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagaggtgagtattgtggctggtggtgggagtgggcgatgaacatcattaaccagggatggggagtgaaagtgaccaggaagggcagtgagagagagaaagatggtgggcagatggtgaagggacatgaaaagggatgcagcagaaatgaggcaaggtgcagtggtgaaggcaggtgaggcgaaaggtaataatggctttggtgtgagagagaagttgaattgggagtaaagctgcaagccagtgagtgggtggtgagagagttgagccaggaaagaatgaagtaattcattaaccttagggacctgagctatattagctccagcaggtgacagaaattggtaggagtgggaattgagggacattagccaagagcaaaggaagacagaaagctagggga

SEQ ID NO: 137371 - DNA, 1263 bp, Homo sapiens
taatgcctacttgcagagctgttgattagaggattagagataatgtatgtaaagtacatagaagcctaataggaattaccatagctggtagaatcagatggactcttttatgcctccttgtaggaacttggagggcgctggggtcttcattgtttaaagggggataaataaggtttggccgaatcttccctgccttatgccatgtccacagggctaggctgaggaacttagttcttcagcttcaggggaccgttttatgtgcatatggatggatgaagcaagttgtgactgaaaatcagtaactctgggtccctgagccctgggtctagtttccctttcttcccatagttggattttgtacattggttatctctggctgatgagattatgagtgattctccccccacctttatacacagtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggtaaggaaggaaagaattaaaagacagactaataactgggaggaaaaatgggaagaaatacgacagacagaaggataatgtccacaacttagaaatttctcatctaaatcaataagaaaaataccaagacctaaacgggaaaaatggataaatgtcacaaacagttcaagaagactttcaaatagtccctaaacacatacaaataatttagtcttactaaagaaatgcaaattaaagcaacaattagatacaatgtattttgtaacacatcgtggaaaatgtaaaaacagaagacacaatgctcaataccagccatggtataggagaccagtattctttttttctttttttgagatggagtcttgctctgttgcccaggctggagtgcagtggcactatcttagctcactgcaacctccgcctcccgggttcatgccattctcctgcctcagcctcccaagcagctgggactacaggtgcctgccaccacgcccagctaatttttgtatttttagtagagacggggtttcaccatattggccaggctggtctcgaactcctgacctcatgatccacctgcctcggcctcccaaagtgctgggattacaagcatgagccaccgtgcctggccaggagacgagtattcttatgtaatgtggcaccatccttcaagaagcttcacaatgcatttatactctgtaa

SEQ ID NO: 137372 - DNA, 3352 bp, Homo sapiens
tcttacccaaacttttccacctttcaaagggacgttaggattggccactgtgctgatctggagtgcacacagcaagctagtctgcaattgcctcctcctcagtccatacagtctcattcagatagggtagggttgcatgggtacagaactagtgggctgtcttttttgtttgttttgagacagggtctcattatgttgcccaggctggtcttgaactcctgggcttaagctgtcctcccattgcaacctcccaagtagctaggattacaaacacacactaccatgcttggtattgggttatcttaaccactaggcaatacagttgcattcacttcctgatatagattctagtctgtccccctttccatactgggaattaggattcctgagccagcttccaaaagcttcatacttcagttttcccttcctactttactcagtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaggcttgttggggattgggtcaggccagtgttcaagggcccctcctctagtactccctgtttgtgttctgccactgactgagcttctccccacaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaaggtgtggattcccttgcccaggctggagctggacaggctcagtactggagattcatttgttcagcttctccccctcttctctcttccccctgctgtgtgtagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagtaagccacaggcagtgctgtttttagcagtgggagtcctaagcctaggtcagccaccaccttaccacctagcccttctttcttgttcccttcaggagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggtggggcctggccttcagccctgttctccaaaggccatccacacattcctggcctaggtttctctgggggtggggaacttgtttcacttccccgtctcctcccagcctgccgcagggagtcaggtatagcatagagtcagacagccaggggttcagagcttggctctgccttgagtatgacattaggcaagtattttcacctctcagtgtcaaccttcacatctttatctgtgaaatgcgagttaagatgatacctactcggccgggcacggtggatcacctgtggatcacctgaggtcaggagttggagaccagcctggccaaacctgtctctactacaaatacaaaaaattagctgggcgtggtggcaggcgcctgtaatcccagctacttgggaggctgaggcaggagaattgcttgaacccgggaggtggaggttgcagtgagccgagatcatgccattgtactccagcctgggtgacagagcgagactctgtctcaaaataaataaatgatacctactttatagggtcattattgaatgagttaacatgtaaagtgcttaagactaccatgtgttcagtttatgttatgtgctattgttagcataatttattcattcaacaaatttgaatttttgaaagtgagctatgggcatttcagtccctgcttgtggtagtgggcggggcggggggggactgttctaggtatattaatgtgttttgttttttttactgactacttccccagaccgccctagaggttttatatgtagtgtgtgtatttatatatctttttctaaactcaaaaaatctaaactgaattctgaaacaactctgcccccaggggttgtagatcaaagactgggacctatacctaatgatgtttactgtgtccccagccctgtggattgaagctggctgaactggatgccagggaagaagccatgtgatggcttcagtgcaacatcatggaggcttgactagggcagtagtgctaagccaggttctctcagttgtggagagctagcccttcctgactgtggggccaatgcagtcaaggtagctttttctccaaggagcctggtctgctttgtcctctcaacccattgcctgtaggaaaaatccaagctggagagtgagctagccaactttgggcctcgcattaatgatatcaagaggatcattcagagccgagagagggaaatgaaagacttgaaggagaagatgaaccaggttggtagggtgtgggccatgccagcgtgtgtgtcagggcaggactgggactggaagcaggacagactaaaagggccgatgccctccctggcttctcttctcaggtagaggatgaggtgtttgaagagttttgtcgggagattggtgtgcgcaacatccgggagtttgaggaagaaaaggtgaaacggcagaatgaaatcgccaagaagcggtaggtgggaggattggtagaagagattggcatgcccttgagcctctagcttgacatccttggaaaaccagatgctgtcataggcaagggtcagctcttagaactatgtgagtttatgtagctaggccttaaagaacagaaatcaggagggcagtatggcatagttatagtggttaagagtgccaactctaaacttgattttctggattcctggattacaaccccagctccacaactcgttatctttggcagtgacttgacttctgtaagctgcaatatctgcaaaatggtataatgatacctatctcatggcattgttgggaggattaggtgaaataattttttttttttaagattacctgttttaccttttttttttttttttttttttttgacacaggatctcactctgtttccgagactggagtgcagtgtcaatcttgaccttcccaggctcaggtggtcctcccacctcagcctcctgagtagctaggactacagatgtttgccaccacgcccgg

SEQ ID NO: 137373 - DNA, 2467 bp, Homo sapiens
gagcaacacagtgagaccctgtctcaaattttaaaaaataataaaaattttttaaaaataatgtgatagtcattaatattaataacaaccctatattaagcacttaatgtgtattctatgcagtggagattacccacattttgcagatgaggaaacaggtacagaaaggcctgtgaagctttatcttgatttgagcctccatggttggtgaagaagatgccttggctgggtagaacacctatgagaggttctggagctctgggaggcccccatcattagttagtagatcaaaccgaacaccatctatgtctgctttttagtaggcctcctatattagtgacagattgtcctggactgttcggctcttggatgagtgggcacataaagggtgtgatctagagcccccatggtcttggcgtaaactcgtgcagcccctgatgatggaatgtttgtttcccaggccaagatcaagcaaaagctgcgggaaattgaagagaatcagaagcggattgagaaactggaggaatacatcaccactagcaagtatgtagctctgcatctgtcccccttacttccaggcctgttcttgtgaccctacctacatgcccctcttcatgcaggacccccagagctctctgagccaggagtattttctcaccagccggagtaactcctgtgtgccctcactttgtaggcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtggtaagagcagagagggaactcatttcctgagcacttacactcactgtcacacgattttcccagcagccctgtaaggacagggttgccaatcccatttttattgttgggggaaatgaggctcggagaggtttaaaaaagcaccgcttctaagaggaagaactgcagttcaaacccaacttgttctcctgagctcatgttctttttttttttttttttttttatttttcaacctgtcatactaggcaatcatgttcttttcatcataccaattgcgtctttctgaaggttttgtcttgctatgtctatgcctctgggaggggaattggaaaaccaggaaagattttggaagcaggtggggccatggggctggaattactctcccaggaagtagctctgtgcagtcttataaaggggctcccttggcatgtattaactggtccagtagcttttagggacaccctgagctttatcagatctcttgatcttttggcctctttcaccaaatcctgagttcccaggttccctgaatattatcccatacctgggttcaacttagtttggttccactaatatttccctatcacttctctagacactgctggggagataagtatggttagagtcagtccctgcccccttaatctgatagttcttagggaaccaggcttggttttggaggctgcaggaagggaactggtagaagagattgattgattgattgattgattttgagatggagtctcgctctgtcgcccaggctggagtgcagtggcacaacctcggctcactgcaatctctgcctcctaggctcaagtgattctcctgcctcagcctcccaagtagctgagattacaggtgctcgccgccatgcccaactaatttttttgtatttttagtagagacggggtttcaccatgttggccaggctggttttaaactcctgacctcaagtgatctgcccgcctcggcctcccaaagtggtagggttacaggcgtgagtcaccacgcccagccagatttattttgctaagtgcttgtgagaatttgaaataatatatataagatacttggcatagtgcctgggtggtggtggtctgtaaaatggtagatgtgaggtttagaaagatgattctggattcagacacgactgcctgaagtcattgcttgggaaccagaataggcttttccttgatagcatgggggctgtgttcttctgtgagataggaaaaaaccaaagtgttttttctactctcacaaccagcacaacacttcacttctgacaccagaagtgtgggggtttttcctcacacaccaagcaattctccagcagacaccagctgggtgacctataattcacttcagctctgacactatttatctggagatagcatcagatcctgtgggttaggggctcagtccaagacttcaggtgccaattgcaagtctcaggttgtgacttgtggttctgactgacctgctataaattacagttcccgagaatccctccctgggttcgattaatttactagtgcagctcacagaactcaggaaaatgttttacttat

SEQ ID NO: 137374 - DNA, 2603 bp, Homo sapiens
ggctggtcttgaactcctgatctcaggtgatctgcctgcctcagcctcccaaagtgctgggattacaggtgtgagccaccgcgcccggccaccttttttcttttattttcttggttagtttccctccagcttccaaactcagcacagatgtcacctttgggaagccttctgagatagatatccctatcagtctcctacccccaagcttcattttgtccttttcctatgctgcttctgttactgcacataacactttgttgtctttgtccctttggctccctgtgctcctcagagggcaaggaatttgtcctcaaagcccagtgtgaaatgtggcagcaggggcatgggagagaaagttggtaactttttctgggtgaaggagtggaaatgggtaaggtgaactgggttggctggggtctgaagtggaagagtgtttcgacctttactagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggtaggtggccaagctacctcttggctctgagggaccaggatggagccagtgccttatcgatgcacccctgccaccattcccctgtttgcacaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaagtaagaggcagacctgggcctgcaacttgtgggaaaccaagaggccgtgctgtttattagggttcctctgagcccggagttcagtacctatactcatttctctgttattctcctaacttgcttttgtaagaaccaggcacatttcttgacttgcagtttagacaaatagaatatttaagcactcaggccctgggtagacaggtgctcagatgagggagaactcaaaaggggtggtggccttgccaagaaagaggaaccaatgtgaggccgagccaatggagtggctgagaaggccttcctagaagaggaaactgaagctagaagtttaaaggataggaatttgaggggccaactaagtaaatacaggatgttcttgggagttgttaatgagcttcctggccagggttgaggcagagttggtagctttgccttatggagtggctggaatgccaggctgaagtcatacctttcagggagtagtcagactgcccctttttttcaggatctgtggggcattacgcccatgttcttttaagtaattccctgaggttggctcaggggctcaagctctcctttgggtgaaaagcctgggaaccctcccttcttccatagttctcactggtttcccccacccctctggcaaaagggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtaagctctggaaggggttggcagggaggagatccctgggctgacatctgctgacttggtcatccctgttctccttccctgtccctaacacaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggtgggctatagttataagattagggatgatggtccacagaaaaggatatatataggttgagcatcccaaatccaaaataatccaaaatctgaaacgtttccggtcctaagcattttggattagagttacccaacctgtaatgatagtctttttttttgtttttttgtttttttgagacagagtttcgctcttgcccaggctggagtgcagtgatgtgatctcagctcaccacaacctttgcctcccgggttcaagcaattctcctgcctcagcctcctgagtagctgggactacaggcgtgcgccaccatgtccaactaatttttgtatttttagtagagacagggtttcactacgttggccaggctggtctcgagctcctgaccttgtgatccacccacttcggcctcccaaagtgctgggattacaggcttgagccactgcgcctggccatgataatcttaatgataatgacaatga

SEQ ID NO: 137375 - DNA, 2279 bp, Homo sapiens
tccttccaattcccgaccctgtccttgtcctagccttgaaagctggccaggctaaagccacagccgagctcccaccttcctcttgccctgaggggcataatcctgctgtgacttctgtctcagcaagcgtgagctcaggtctcccccgcctccttgaacctcaagaactgctctgactccgcccagcaacaactcctccggggatctggtccgcaggagcaagtgtttgttgttgccatgcaacaagaaaggggggcggaggcaccacgccagtcgtcagctcgctcctcgtatacgcaacatcagtccccgcccctggtcccactcctgccggaaggcgaaaatcccgttaggcctggacgtattctcgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtgagataaacctggccgcggccctgcgcacgtcccggcctggaccccttatccggtgccggagtagtacaacccagcccatgtaacctgaaacgtcgcggaccttacgggttccttgcccgtccagagggggttctgctcgaacccactctccccgcgcgggtgctctaactcgaaccccttccaggtgtcacttgccgcttcctgcgcggcccccgccccggcccagtggtacaggccgagctgccagttaccccgcctacttccccctcccgccaaaggagtcgcgtctggaaccagcttcccgccagctcagtcctccgccgcgcggctccccgccggaccggccggagccggcttcccagccttacttgaccccctccggagaatgtggggacgctggtagctctcccgtggccttcggtcccaaacggtgcacttctgtttcagcccagcgtcctctctcgcctcgcattggtacactccaactcctttctactcttctctggaggcggcacttttgaatttcagacccagcgctccagtctttagaatgcttgaggtgtcgatccccaccccccaccgctatgtcagaggtagttgcctcgaactcgcccttttcctaccaccgaaaccgtcaaaagccgaaattaactaatttaccaaatttgttgaatgcttattgtttatcaggagttattcagttgcaagttgtggaaacagcggagaatagaataaaccaactccatgctcacagggaacttatattccagaggggaaagaagataaggagaaaataagatggttttaggctgtcataagtgctatacaggaaatgagacaggtggatgtgataaagtgacttaggtggtgtctttagaaagggtggtcaggtaaagcctctattttgtgtcttcccaactctaaacgatacaccgtggattcctctcacctcagatgtccatttggaatcctgctgtattcttccaccccagagatgttctagctgaatgatatcctagcctaagaggctgcccttgctgaagtagcacatactgagtacctttcctggagactgagtgtctcaacagtggcactattgacatttccagcgagataatcctttgctgtgggatgtgctctgtgcattgtaggatgtttaacagcatctctggcatctacctgctagataacagtagcacccctgctccccaggcatgacaatcaaaactgtctctagacattgctagatgtcacagagggtgtgtgtgattcccccaaccccccaacttgtttgagaaccactggcctggagggctaatgcttggtgtccacccagtttcctcgggttttagtgtagtggcccctgttggaagagctaggatgtacctcttggcattcagtcccctcagcattagtagatttgtattcccagctgttctgaaaagggctatggcactcccccacttgcccccgttcttcaaggcccacctctacaagccattcctttagtccctttggtgagtgagtcttcctctgtggcataccgtagacacttggtacacgttaatgtttattaagtcctatattgatggtgcatgtttttgtatcttcattggcctgtgagtaccctaaagcagacattccttgaaacgttttactggtgttcagtccataatatatattacaaa

SEQ ID NO: 137376 - DNA, 1073 bp, Homo sapiens
gcaagccgggcgaccggcaaatgtcgcgagaatacgtccaggcctaacgggattttcgccttccggcaggagtgggaccaggggcggggactgatgttgcgtatacgaggagcgagctgacgactggcgtggtgcctccgcccccctttcttgttgcatggcaacaacaaacacttgctcctgcggaccagatccccggaggagttgttgctgggcggagtcagagcagttcttgaggttcaaggaggcgggggagacctgagctcacgcttgctgagacagaagtcacagcaggattatgcccctcagggcaagaggaaggtgggagctcggctgtggctttagcctggccagctttcaaggctaggacaaggacagggtcgggaattggaaggacccggggggagcggagagctggacgggaaggaggggccaacgggaggattcagtgttaggtgagctcagactttgctaatggtggggtgggattggtggcgggacgggttgcgaaggcggacgggttgtgaatgggactggggctactcccaggcaacagggatacaggctggggaaggctacggcctgagatactacccctatcccctgcctccctcctgttgtaccaagcagagttcagaaactgccgccgtaacccaagaacaaagttgcatgcagagccaacctaagagcttcaaaatcgggattccttactgagaaaggtattttgtgtgaacccccaggagtcagggtccctaagccagcgctctccacctccacctacctctgcctccatgcctctcccccatcccattcccacagctctataccacaatgccaccttacctctcttccctctctgctctctatcattaataaggcaggggccttagcaatccaagaagcttaaaatgtcagctgaatcttccccttcagtgaccttatactgtaatggcaggtgaaaccagtaggtaagttggtgccattctcagacttaaacatggaaaggatctggtggttgccataattattcctttaactatttattaaattatgtccgaaggctagaaagagtc

SEQ ID NO: 137377 - DNA, 1292 bp, Homo sapiens
caaaaggaaagtttggccgtgtggatgtagctgtcaactgtgcaggcatcgcggtggctagcaagacgtacaacttaaagaagggccagacccataccttggaagacttccagcgagttcttgatgtaaggccttggaagttctccagggatagtggtagtaagaagtatctggctgtggaggaccccaaagtttttaggggacaaaggcttcttctgcctcaggtcctatagcatgtctccatctgtcctacaggtgaatctcatgggcaccttcaatgtgatccgcctggtggctggtgagatgggccagaatgaaccagaccagggaggccaacgtggggtcatcatcaacactgccagtgtggctgccttcgagggtcaggtgtgtgggcaggggtaagacttatgcctcctaagtgacttgttggggccctcccacctatgacttctactctttctccaggttggacaagctgcatactctgcttccaaggggggaatagtgggcatgacactgcccattgctcgggatctggctcccataggtatccgggtgatgaccattgccccaggtagacatatcccctctctccatcatacctgggattgggtgggatccatggacagttgagaggggaaggtatccaccacctaagcagcagcagccttttatctttgggccccagagaagcaccaagaagtagggctaaagtaaggaagaaccaggtaatcatgaaagcaagggtgagtctctgaatttggctatattgtttaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagagtgtaggcagtgttgtgtgctagggggcctggcatggggaagaaatgtgaaggctgtgacagggttggatgctcagagctccagggtggggtgggaaaggcagtaccttcataatactttgtgtcctgttacaacatgtggacttgattttgagtgcagaactttattacctaggttag

SEQ ID NO: 137378 - DNA, 1394 bp, Homo sapiens
cagggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctc

SEQ ID NO: 137379 - DNA, 4133 bp, Homo sapiens
gtagcattgatggccatcatacctaaatactcctgggcttctccaccccatctgcatttttcatcagcaaaacagagtcacatgatttttgaaccacacagtttctaaagttctgttccatccgttgggggtagtacaggaggcacaggtggccatagaacacacacagcagggttccaggggcttccacaacactcctggagtcatccctatgcctctccttctcctcgtgcatgtatacatgcttacctgcttgtggcagaaatcacatgtcacaatctttgtgggcccttactcagtggaggtaagaaaaatttagagttggtaatgagtgatctacctctcccaactactgggcatttcccaaacaggtgtggagcagagatcaaagtgtttggaggatagaaggagcatcattgtgggtcttcttcctaatcacacaaacaaatttgttctgccacccttaatcctatcttccttccttttctacctcccaagatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtaagggcccaggaacggagaaaagatggcgggtgggaggtggggcctcctgcacagtagcgatggcttgctctagcctcaaatttagggaggtgctgccctccctaataggaattccccataggaatctggttttagataatcttactgagttgtctcctatcttctgggcctgccctgctggctggccctttagctaagctacccaacaattcccagacagacaggaaagtctttggtgtttataaggatatacctgctggctttgcaatgagagctttaatattgctatactaggaatgaccatgtatgagtggcctccaccaaactggtaactgctcactggtgattctgaagccacctagaggagatcagcagtttgtaatactgagcgtaggagctgatgagatgaaagacctattggagttgtttaatgattcctccccatctcttgtggtgtgggctctccaactgtgtaatcacaagaagtcagggagtctccctagacagactgtatgccatgttcttccaccaccaaatacctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcaggtgaggatgaggcatagtcctgggactgtcttcagtcctgggggtctggtctttttgtgtcccatccttgtgctccttcttcccccccactcgcaaaccatgaccctgtataattgtgtttttctagatatacagatatggagagtgaagattaccacttctaccaaggtctggtttatctgctggaaaatgatgtctccacactaggctatgacctcaccttcagcactgaggtaggtcaggaaatcctaatcacagcacatcccagccaatctggaagatccattccaggttcaccttagaactagcactgcgtgaccttctcatagttctaaggaagcatcttgacttcttaaagctgtagcaggtgtttgtgagtgacatcacaaacaggaaaaccagaatttgcaggccatttcctagtttcacctttattaaaaaaaaaaaaaaaaaaaaactccagtacataattcctcattcccaagggtaggtctttgtagaaaaatcgtacaaatgtaagtggggggaaaatgaaggcagttaaggttactcttctcctaaattcttttcctaagagattacattccgttacatatgttagccattcccttttcccttttaccactgatagttgccttactctcttctgccttttttgtaggtcttagagccaaagagtattttcctctttcctacccaaagcctttccctataaggggagttgcgagctatgagtagtagaaaaagtcactgttttgtatggacttgcctcatctctctgcctaggacatggcaaggggtttagggtgtgttcctaggtatctaatcccatcctagatgaagtctgatatgtatgattggtgttttggttgttctaggtccaagagtttggagtttgtgaagttcgtgacctcaaacccaatggggccaacatcttggtaacagaggagaataagaaggagtatgtacacctggtatgccagatgagaatgacaggtaggggaaatgttcctagacctctagttgctcaatatgagaagaggtcggacttgattcatttgataggcatgttttgttttcctctgctatgacagagccacaaatgccttgcacaaaagacaaaacacttgatcaaaaatacttaactttgggcacggtggctcacacctataatcccagcactttgggaggccaaggtgggcggatcagttgaggtgaggagtttgagaccagcctggccaacatggtgaaaccccgtctctactaaaataaaaaattagccaagtgtggcagcgtgcgcctgtagtcccagctactcgggagactgagacagaagaattgcttgaacccgggaggtggagtttgcagtgagctgagatcgcaccactcttctccagcctgggcaacagagtgagactccatctcaaaaaaaaaaaacaaacccagcttaacttcactggacacagtggctcacatttgtaatcctagcactttgggaggctgaggcaggaggatagcttgagcccagggggttgagactagcctgggcagaattaaccagttgtggtggtgcatgcctgtagtcccagctaacagtggtagatgggagccagatgggggatctctgacctctacggttgtgtgagtttagaagtcatttggctttttggttatctcaccaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcaggtgagctgctgctggcatccctcctcatatggtcctcttaccctaggcaacgctagtttgtgtgataccaaataaaccagtagtactcttagaggaagttgcatgtagaagacagtctacctatatctaactctttgttctcctgaagcatagcagacttctcttggccgtcttatgaatgaaaggagctaaagctcatcccacagaagggacttgcctcagataccaagtccagtcctgtttcctagattccatcccccccaccctgcttctaggagctttctacctaacactggcttcatgggtcccttcctacagatccagtggttctggagagcattgcgttctttcgatcaagctgaccgtgccaagttcctccagtttgtcacgggtacttccaaggtacccctgcaaggctttgctgccctcgaaggcatgaatggcattcagaagt

SEQ ID NO: 137380 - DNA, 2298 bp, Homo sapiens
tcttctttctttcttttttgttttttgacacagagtctagctctgtctcccagggtggagtgcagtggtgcaatctcggctcactgcaacctccgcctcctggattcaagtgattctcctgcctcagcctcccaagtagctgggattacaggcgcctgccaccatgcctggctaatttttttttttgtatttttagtagagacagggtttcgccacattggccaggctgatttcaaactcctgacctcaagtgatccacctgcctcggcctcccaaagtgctgggattacaggcatgagccacggccgaccagccttagtctcccgtgttttaaatcttggctcccccatttactgcttctgggacctgaggcaaacctctttgttaggtttccttgtttaaaataggaatgttcagttgttaggattaaatgagttaaaacatgtatagtggttagagaagcacacgatgaatgctattgttagcagcatttctcaaagtcagtcatacatagaatacattttggcaccctcataacacattcccatggaatagtattcttgtaggacaaccattgttatcctacctttcatcaggatttggggagatagatattattttcgtgttctgtattcaccttcttttacctaaggtcatatgatttgcaagtaccggagccaggattcaaacctaaggctgtcagaaccttgaagaatagtcaggatttgggtaaaggatgaacagcaaaggtcaggaagaaacctaagcagggccaggtgtatggggatcaggggttgatgagaaaacagtcacttactccccacccagaagatggggttgtgtcttgctgcttagctactgagcagaggttagaataagcccccagtgagtatcaggaaaagtaccagccatgggattccatctgtcataccatggcttctcagggttttaaactgccccaggacaagatgactaatttagaaggcattagaaggccgggcgtggtggctcacgcctctaatcccagcactttgggaggccaaggcaggtggatcacgaggtcaggagttcaagaccagcctgaccaacatggtgaaaccaagtctctactaaaaatacaaaaatcagccgggcatggtggcttgtgcctgtaattccagctactcaggaggctgaggctggagaatcgcttgaacccaggaggcggaggttgcagtgagccaaggtcgcaccactgcactgcagcctgggcgacagaacgagactgtctcagggaaaaaaaaaaaaaggcattagacttaaggttagaaagatttagtttgatgtcctggtgctgtcttcctcagaaaccaaaatgaggaaaagacagcctactttccaaggccagctgtcagaattcaatgacaaaagtgtcctaaaacatcctgtgtaaactggaaggcaaccatccaaagctccactgttgttacattaccctgaaataatccacagattctcttgaaactagtgaggcagtgactagactagcactatctggatctgcagtagcacctgtggcttttgagcaccttaaatgtggctagcgcaactgaggaaccagattcattattttatttattctgtttaatgtaaatgccatccaatgcaggtcctagaccttgtttcagatgttgctcggtgagtaccactcagtggccagtggtcccctctacttgttctgtatattagttggtgcgtgtggtctagaaagatctaagcagaagggaaattttgaagactttctgactctcttctgtgtgccctccagcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctaggtgagttgtgtcctaaaggcccaggtcccaacccagtggtctgctctggggcccttcctgccagcttgtttttcttccttccaggttactcctctccctcagtgtctctgtaatgagaattcaaaagagaagtgttttttctctgacttcagtataaaaaagattgaccttctcttttaatagttggtgtctttcactttatagacaaggggaatctttataactggttagctatcccatttttctttggcttcaaggaagttcctctgtgacttgattctaccatatttccctgcaagttctcattgtttcttttttttttttttttttttttt

SEQ ID NO: 137381 - DNA, 3076 bp, Homo sapiens
cttggctgccaccatctattccacacctatgggccaggcactgtctaggcactctaccatataattatctcttaattgtcacagcaacgttatgaggttaggcagtaatattcccatcccagtattaatattggttagcaaattgggtaaggggtcaagaaatttgcctgaaaccaccacagaacctcagtaattttgagagatatatgggatttcaaccatggtctgtttagctccagaggagatactgtttctcttctacatgaaactcatttcatgcagattcagcagatccctgtggccataggtaaattggtagtcccaggtgacggttcgtggacacgcataataagctgaacagagcacgattccagctcactctaggttctctgcagctgagcaatgaagagtggcctaagcaggtgtcttagagagatttggcttttagccactttaccaggggagtctctgaacacttgctgactcctctgcctgctcaggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtgggtggtagccaccctttggctgggggcttgaatctgggatattctggaagatggctcttgctggtttcctggtcttttttatttctctgggtgattttcgtatctttcctatacacacttgacccatttttttctacttcctacttggaagatttccttctgagtttccttacccctctggttgacaccaggaagccttgcttgctttgggtgtttatactttgatgctgtcaatatacgcaagccacctctacactatccaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggtatggaactagagtgtccagttgaggggaagggttggtggcggtaaagccagattccttggaggtgcaggacttaacggcctgtctccttcctgtttgacctttccaaaaggaaaatgattatccttttttcagaatgttgatggctgcattctacatctcattcaagctatctgcgtaggaaattcattagggggagtgggaattaagggggagtggaaatctggcagggaagttgggggccagccttttgctgaacaagacttaactcactaggtgcatctcctttctgcttccttggtcatttctaactaagccgtggcttgacaaatcattttccctacctctttcctcctgtcccacagaaccctctcgcacaaaaccatccgtctgtctagcatcatgccccctgcccttatctgtaatggtaaatcttagcgcctgatgatgagcactctgaagcttcctgagctaaagctcaaaagacctcagcaagatgccctgtggcagcccaggagataggagagagaatattgggctttccctcttcctatattttatatcttgccttcctctttctctttctcccaggttcctccggtttaggctcagctagcagcatccaggcagctgttcggcagctggaggctgaggctgatgccattatacaaatggtacgtgagggtcaaagggcgcggagacagcaacaagcagcaacggttagcatgatgcctgtggcccctcattcatttgtctctccactcatccccccaccatgtcatcagtggggtttcattgcctttaccttgtatgcttttgcattaagtttgctatatgaatgcttctggacaaaagggttactttctgttggtgttttcctatttgttgattggtttgttggtttgatttgatttaaagcttggccatcataccccactcccagctatccagtcaacagtggcgcttttgcaaactgcctgatgctaagtgttgtctgggttctgaggggttatggggtgaagttttttttcagtcccatggaacaatgcaggtacatcagaaacatctcaggaatcctaccattgaaagtcccccaagcttggtacatatcccacacagccacttctgtctgtggctgctccctccaccctgccctctgcctttattctccataatcccttggcacctaggcactcaggcacttttaggaggaaaccttcaggtacttaagtagccagctcagtgttggggtcccggcattgagtggctgcagtaaaagcctggcatcacatgtgtatgctgtggcactccctcattgttttcctgtccttgcaacatgtaagttacctttccaagatccaagaaaggtatcctaagacccgatatttctttgcgtataattactattatacagtatggttttattgagtaggcagggaaaagccttgaacttaggggcagtgactccaggaaggtagaaagggaaaataaagctgttattctggagtattttttctgccgagtctctttcccattacacgaaaagatgtcggctttttaaataatcccgctcatgagaggttgctctaattctcctattatttccccttttgtgagcaaacagaaacaaagagcagacctaccttccacccatctgaattttttatacacacacacacacacacacacacacacacacacacacacacacacaacagaagaagacttgaagtctatatacaggaggctagttctgactggtcacaggtctggattgtagactgtaggaaatgtaagcatccaaggagctgttgggaaaagcttacaaaacacagtggagaaaagcagaagagttgggaaaggcatccttttgtcctggatagctacagttttccccacccaaatatgggaagcttctttgcaagctcaatgtatgagaagtggaagggccaacctctagcctgtctctaagga

SEQ ID NO: 137382 - DNA, 7700 bp, Homo sapiens
gttttgccatgttggccaggcttatctggaactcctgacctcaggtgatccacccgcctcggcctcccaaagtgcttggattacaggcatgagccactgcgccctaccgaaaccttgtttatttagagaactacagggatatgcacgtgcaagtggtgcctgcagtgaatcaaagtgaaaaaatcccttacccgggctgggcgcggtggctcacacctgtaatccaagcactttgggaggccgaggcaggtggatcatgaggtcaggaattcaagatcagcctggccaagatggtgaaaccccatctctactaaaaatacaaaaaactggccgggcgtggtagcaggtgcctgtaatcccagctcctcaggaggctgaggcagagaattgcttgaacccaggaggcggagattgcagtgagccgagattgtgccactgtactccagcctgggcaacagagtgagactccatccccctgccaaaaaaaaatcccttacctggtttgcctagggaagatgtttcacaggcatgcctggaacacagtaaatgttcaagaattgatagaaagggcttcagctgaaccttagaaatctcaaagtgagattgagagggggacagcaagggagaagtgagaagtctgagctgagatgcccctaaggaagcagccctatcaaagaccttatctgtcattttgccccggttccagatagaaacctaacctctccctgcaacttcttcctagcctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacaggtaagcatgtgtgggcaaaagaagggtaggatatattggagggtctttcaaagcacatttcatactcgtcaactaatggacatgcttgttatgctggggagataaagctggtttctgtgagaaaggggtattgtagcagtgttttataaacgagaagacataatacagacagcaacctgagcatgatttccctcagctccccacctgcatcctctgagagctcttccaccagagattctgccgtggccatttctggagcagattcccgaggaatcctagaagagccgttgccttcaacaagcagtgaagaagaagatccccttgcgggtgagttccgtgtatgcccaggtcatcctgggattgttttggcttctagtagcccttggcatggaaatgcccaccagccaaacagttccatttagatggagggcatgtatgtgggaggactgacaataagcgggggtgctggtatggcataatgaaacgggtccagccttaggagtcaaactgatcttggctcactcaaattcccccactctgccacttctaccttttacaacctagggtcattatttaatttctgtgatcatgaatgataccgagggggtgatgatatctgcgtggtaggttatttatgaagggtaagtaacagtgcatgcagtctagcaaataacaaaagctgttctgagcccagggaaggtggggtgggccttctctgtgtcccatgtcttgcaagcagtgaagacatatacactggtttccctcaaggagtgacatgggtttattttctccaagtacatattaggcaccaatagaggtgtgagaggctgggcgcggtggctcgtgcctgtaatcctgaaaatttgggaagcagaggtcagaggatcacctgaagccaagagtttaagaccagcctgggcaacatagggagaccccatctctacaaaaatatatatgtaaattagccaggcattttggtgcatgcctgtaatcccagctactcaagatgctgaggcaggaagactcgagcccaggagctcaacactgcagtgaggcaagggttgcaccactacactccagcctgggcaacagaccaagaccccgtctcaagcaattaataaggcgtgaatccctttacatgttatatctcccttcaggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtatgtgagcgggaaggtggtggggccaggctgcctggcaggagaaatgccctcattgactttttctgctccataggtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccgggtacagagggaggcaagtgggagggctctggaaagctttagccagatgaggctatgttttcttacctttgtattacctatatccagtttacaccctctccacaatctcagttttctttttctttccttccagctttcaccagtcgcttaagtggcaaccgtggggtccagtatactcgccttgctgtgcagagaggtggcaccttccagatggggggtagcagcagccataacaggtacctttgtctatttttaccttaccatatcaccactcaagtctattagcccagctcccttagttttataggtggagaagctgaaatcctgacaggcaggatggatggtctctctaagccatttccttgaataagtgagagagccagatctttggactccccattcagaaaactacaccttttggttagtcttgctaccaaagaccacaatcgcaaaagcaggccggcagcaggtgctaactatggttttaacaagaaggaacaccacttgtctcccatgcaagtagtaaaacaactaaccacctgccttgagtttgtaacacctaggctaaggaagtatagaggagtgagttagccaggctaaaacagagtgggcctgacatgccaaaatgtgaaaggagtgattggttcctacaaggccacaaactcctggtagtctagagaaggcagaaactagcattgtctcctagacttaggtatggtcagattttaccagtcgatggatgatacctgggctggaatctctgctgtcttctcagtcgccgtgtgatgtagggcaagtcacttaacctgtttgagcctcttgtttatcatctcaaaaatgggtggttctcggccagttgtcgtggctcacacctataatcccagcactttgggaggctgaggcaggtggatcacttgagtccaggagttcaagaccagcctaggcaacatggcaaacccaatctctactaaaaatacaaaaagtagtcgggtgtggtggcgcgcactagtaatcccagctactcgggaggctgaggcacgagaatcacttgaatcctagggggtggaggttgcagtgagccggtatcacgccactgcactccagcctgggtgacagagcgagactccatctcaacaaaaagctggtgggggtggggggcttcattctctaagctgtacagcagccctgaaaggatgatgtacagtcattgtaaagtgcctggtacatagtagacacctaagagggcagctgttactatgaagagcccttggactggacacccacctttctcaagcctccttggagatacctagctcattcccctcccccattcttatgcctaatcccagagctctagccactgaagtgttacccaaaaaccatgttctgtttccaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtgagggtttcaaacccaactcctggggatggaagaagggtggcagcaagagcctgggtgaaagttgaacactaagcaggctagcgtgtctttttgctcttattttaagtgttgagccctgtattgtttctaggggattgtcctatatatttctggggttttttcttcattcttttccatttttatgtatgtcttatttagtcatcaaaacaactgggctgtatgattcctgttttacagatgaagaacctgagattcagaacattttattcattttgtcttatgattagaaagtgatggagctggacctagaatttagtgttctttcaataataagcattgctgccatctatcaaaggcctgccttgtgccaggcactgtgcaaaatacatcatgtcgtttaatctccaacaactttgcaaggaagtgtagttatctccattttataagtgcgagactaaagctcaggaaaagtttgctcgtgagtctgtattgctacaaagccctcattcatttctctaggctgctttactgtctgttggataaaactcttatatgacatatcccccaatatttaccaaaattgtctgaaggagtctgggaaccagttgtcttttccctatcaggaaggctcatcctctgtgaagacgtcctagaccaagccttgtcctccttttcccggcaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaagtaagtgtggatgtagactgggagctgtggggtatatactgtggcacccacttcacccccttttccatccagatagttctccctcagtgatagcaatcagcttggtttgtgtttgtgagaacagaatgtgttcattctcaccctcatctgtcccagttctctcactctgtctcccttcctccatccccgtctctctgtgtctctctctttctctctctcccctgcctctcacacacacactcttttgaaggtcagcaggcattcactgaatgtagcttccctaggctaggcaccagaaggaggaaagaaagttaagttccatcctcagggaattcccagcctttccagttgtgttgagggagccagttctcatgggaaatagttcaagggcgggcaggatacagtgtgattcagagtaaccagatcatcccaggaaataaaggtaatgagccctgccacagattagtaagaaagaattatctgaagaagtaggttttaaagaatagagtgggccatgatggtgggggaatagttggaagaaatgcctggggtttctttttcagcttagaagttacagtcataagagtcctctttgagtttatggtgagacgtgattgtgccactgcattctagcttgggcaacagagcgagaccgtgtctgtaataaaaaataaaaagcctttatcatcccaagtcatttagatttgcctttggtgggtgggttttctttttcagtactttcccattttgaagccctgggcaattcagcgattccttgattttgtcacttagtccctggcttgtgagtttcagagaggcttacagtgttctgtctgtttcctcaaagtttctcccactactaagggcagcaaatctccagcgaaggtgagtgatgggggcagcagcagtacagactttaagatggtgtcctctggcctcactgaaaaccagctacagctctctgtagaggtgagtccaagctcttctgatctgctaagacttggggagaaaggataaacagggtagataatgattttgttctcaggctggggcttactccttctgtcttctttttctcaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaatagcagaagtaaagcattttctctttctgaaggtttccacttaggtgcttcctctttctggaatcctttcctgaatccccaagctgaatcagatacctccatatccctataacacagcctccatgctccctctgtcgtaacacagattaccctgggttatcatctgttttcctctgctcagttgtttgaaagcaaggctgggtttgtctcctcatccccgctgcccggcacacagtggtgcttaatgaagagaaaagagaacacatgggaacagcagcgcctcctttcttctccatgctgggcactcgtaagagccccataagacagctgaggcagcttcaccccttcaaagtatgtccctacactgcattcagcctcaggaattacagagtcagaatagtactctctgcttttgtgtaattttgagggtataaaaattctaagaacagttacaaattacctcgtttctatcatcttcctccctgttttactgaga

SEQ ID NO: 137383 - DNA, 1052 bp, Homo sapiens
ccgggaggtgaaggctgcagtgagccatgattgtgccactacactccagcctgggcaacagtgagaccctgtctccaaaaaaaacaaatagagttttgaacgaaattctgaccatttcttgctccaaatagatgaagtgggaggatcaataggattttggtagttagattttctgtgtacctataggtcagagacatttagcctcaccctatatggcctgaaatcttcccccttccacctgcagggcacagaaaggattttattcttagaatccacagagtcagagctccagttcttgcattcttgggacagagatagcactgtgccttaaccttcatccttagtataccagaccagagatgttccttggagtatttttgttgtggggatgatcactggctgggtgggatacttatcaggccacatttgctgattggggtggctcccctcatcattggctggttgccccttaaccactattattgttctttccgagaaagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataagtgagtagaatttcaacatttggggaggatgaaacaagagggaagaaaggatgtctttgtagcttctctttgctcttttgcttgagagaaatagtaggagttcaacttctcaaataataagatctcgtcttgcgcattcactttcttaagtgaagttgaggtcctgaactggtgatagttgaatgtctaatgatattggtgatgataccaacagttcattgaggcaattactctgtttctgggctatcaccccaggcttattat

SEQ ID NO: 137384 - DNA, 2480 bp, Homo sapiens
gaattatacattacagtgtatcacttgatataaaagggggaaaaactgatagaaatacaaagaaataagacttgagagtgaaagactttagtataccctactcagcagttaaggaatcaggtagattaaaaataagggtagtgaagtgttcagttaaaataacaaggttgatctaacaaatatctttatatagaactttttacctaatacacacattgtttcaaacttgatataggatgaaaaataagtgaacctagcctgtgactgaaaagactagagtggacaaaataaaaaataagccccatgaagggaaaaaatacatagatgaaaccaagaaattcttgctagaatgatcatgatcgtgcccatccctaaggggtttttattatcctttccttccatatttatttccccctcagccccaaacaattcttgaacctgagtatgtatagagaaattggtcatatatttgcacagtgaaatgatcaccttcctttggtcacatggccaaagcattctccattagatcactgaactcctagatggtctgggtggaggatggtgactattacagttgacctctatcttaggtgcttgcaaagtcccacattggtctatcccttctttttgcagtgtactgcatctaagtcaaatgactccactgaacagaatctctcaggtaactctccttccctttctcccttcttactaatcaattggttgcttctttatcctgatagttccgagtagctggcccacataggctgaagatggacactggtgctctgtgggatgaggtagtagattgtatagttttagggtcataccccatcttggagataactatacagtctactgtctttcccacggtggtacacttcttctccgactggctctgttcaggttcttgttctggttattatctactttgttctggcatgggtaatgaggtcatgtgtcttgttcatttcctgactgcaactctgtcctctgaaacagcatgttcatgtacatctttgaagtggctggtcctttgatgaccaccatggtgtggcacttcatgagaataactgatgacagtggttctcaaatgccagtcctctgtggaaacgaacaaaatcaaggagctttaatgcctttttcataaagctgaatttattccatttaaaaggctgtttttgtatttagagatcatattcctaattctgtggtaccaaaatatttttattaaatgatgttgattggatgttttttcttacatggctaaactaaaagttggcaacccctacattagtctctactttttgttctttttttaattaaattttattggtccatggaatctaaaagtctaggaacattgtcttggatagtgtgctgttcatgaaggtagctctctgggcttagtggtatgactgccgtatgtttcctattccctctgatcttcttaacaatggtcagtagccattttgtgattctatcagttggttcatgtgatatcatatgtctcccccacccatatttcctcagaacattcttctgcctccctacacctgtctcctttcgcacttgagttggaaaatgattgtaccaaagcctgcacaatattttttaaagcagtgaagtagggtagatgccttggtacccttaatctagcaaaagatctttaaaagagtctgtcaccatgtaaaatggccttttgcctgctgcccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcagtggttcatgcctgtaatcccagcatttttgggaggccgaggcgggtggatcacctgaggtcaggagttcgagaccaacctggccaacacggcgaaaccccgcctctactcaaaatacaaaaattagccaggcttggtgacactcgcctgtggtcccagctactcaggaggctgaggcaggagaattgcttgaacccaggaagtggaggcttcagtgagctgagaacacgccactgcactccagcctgggcaacagagcaagactctgtctcaggaaaaaaaaaaaaaaaaaaaagattttgaagggctggacgcagtggctcacgcctgtaatcccagcactttgggagg

SEQ ID NO: 137385 - DNA, 1391 bp, Homo sapiens
ccctacaaagccggggtcgggcccgcctcctggtaggcaacgatgacgtccacatcatcgcccgttctgatgatgagctgctggatgactttttccatgatcagagcacagctaccagccaagcaggcaagtttgtgtggtgaaagggagggtagaatttgtcagattctactttttccctgctgaggaaaagcaagacagtgtctgccctatagaaaacccccattttataggagccagaaccactcagtgacttagccatgggcaacaaaaactttattgtctctaggtacttgttatgttctaaacattgtgatagaccttgggtccttttagggaaatactgcaatttttggatcggtggatcagttaatgcttgacaaggccaagaatctcattcccctttgctgtccctacaggaaccctgtccagcatccccacagccctgacccgctggacagaagaatgcaaagttctcgatgctgagagcatgcatgactgtgtttcaggtgcgtggcagcttggttatcagggcaatagtgagccttccagagctagggcaaacgtgtggagagttgtttccctggttctctgtggctacaagctctgcctcttggcttcctccctgaccccaccagagcagcctttgatttttgcctctttgaaacagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacaggtgattcccaagggctgggaggattcatctttgactgtgtctgccgtaatgtggttttggcatacacatggcaccaggaatcactgaagaatcctagaacgttcacgttgaacctgggaaattttttatttcaaattcaccatacattgacctggtttttaggggaaagaattcaaacctagaggggagatttctcaagtgtcaagggaaaaactggagccagaagcagaatggcttctcactcaacagtcacactgcatagtctctaccgccaaggacagcatcaagacaaggagaaaaaccttatctaagtccatgctcttagtcgcccacttccatttctgtcggtgaactgccagtgtggggaatcttaccgagatgaccccattccgtcatttgagtaagatcagcctaggtgtcagatcagagaaaatgtttgtactctgaaccccatcaccacatgtcattttttctagggctcacatgtataaaatcactaatacaattttggtttagaaggaagttacctacttttttctgaaacttctgggacctcagacagagat

SEQ ID NO: 137386 - DNA, 5404 bp, Homo sapiens
cagcccagtagcctttttggcagcaagagtgcttctagcaagaacaagtctgagcaggatgcccaaggagcctctcaagattccagtagcaaccagcaggacccaggtagggaatcagagccaatggactggagaggtgggagtagttgctttatgggcctgggatcacaactgttctggcttggtggtgtttccctgggaacttgctggccttccagagatctgtcatagtggcgtgggaatctgccccacaaagaattccttcaaaatgcagccttgtttggctatcctcacacgtagccttgtcttttcctttgtcacccattcgtttattctctgagaacttacaaacttgcccaaggaagggaccttattgtctttgcgcttgcctcatggtgcccagcacataggcactctttgattattttgctggttggttgattgtttcaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggtagggaggcagatcacccagcatttccctgttgcggcgctgaaccaaacccttgccaggtggtgtgggtgggtgagtactttagatccttgcctcaatgctggctgctttgcagaggagcatgggtgatatgcttagtagatgctcagtaaatgtgtttgtactgtattaaaagaggggtgggggcagggccaggatgccatgtactatgaaatgatatagatcccaaccagaaaacttaggcacaggtgaaatgttgaagtagaaagctgacctgagaccgttgggccccgggtctttgatttactttggctctggtcattattggaagctccttaacaccaccttatgcctatagcaccagctcttgctggggcattaaaacagcagtcttctaaagaccctaaaggaaagcattgtaatttctggagctggtagcattgggtaagaaattgggcctgtggtcctaagctgctggctttaaagagatctattatgtcttcctggacagtataaagacaacccagtatcagataactgggatggacccatttgaaggatagtctggttgtggattggtagcacgtggtagtttctgtgctaattagcaccgaatgtgtggtttcacgtaacatcctctgtcacatgttatcctagaaatgtatgctgctttgctggccttttttagggtttcggtgctagcacaatgatagacttgtgtgcatccatatatatgttctatttctctccaggttgagaatgagctggaggacctgatagatgagttgcttgagagggatggcggatctgggaacagtacaattataggtgagagccccagaactgagtatagcctcttcctttgcctcagtctctcttgggaggaccctttttctcatcatctgcttgctcagctctgcctaagggctcatagccagcctagatcgctgcttgtcttgatgttgacggtcttacagatgagaaattcacaagacgtctacaggcctgtggcagtctaaagtgttgcctgtgtgggggaggtggtgggagtggccattgatacagatgatacatcaagcacatcaaaagagtgtttattcatggaggcctagaggaggctgtagggtgagaaagcgctgcctttcagttcttcaatgaagtccaggggctttctgcccctgagtctcagtagtgtaaaaagaatgatcattccctgagggtggccctttataaatctcagagggaaaatggcaaaggtaccctactgtcacctggctctgagggtgtatgtgttacttgtttttactttgttgatcaaggaaatcaaaggataaatggaagtagacacgtattcttaagttttacaaagcttttttatacccagtatcctctgtggtttcacaattagtgggattggcagggcagatgtgatcatcctgttttacagatgaggaaactgagactcagacaggtaaagtgactggccaagctcacctagctagctgacagcagacaatccaggtcttctccctcatccaaaaaaaagtggatatctgctaggtgtacatagctactttagacgcacccagtctggaaagggaagtcctctgttgttcagtgaaggctctgctctgtaaccttcagtgagcagaagtggagaggatgaatcacaagaggacgtgctgatggatgaagctccttccaacctcagccaagcttccaccttgcaggccaaccgagaaggtgagagtgccgaggccagaaaggcctcccttcttgccctgcacgtctgacagacactacactagggttttcctggaggcagctgcccacatgtgcagaataaggaagcatctgtctgcatgcgctgacatacaccatccactttatcctcagccagtttttcaaataacatgttactactgcttgcccaaagtttgtcacttcttacttggttcgctttcttctcacccacctgctatcatcgctccaggttccctcttgccaacaggatatagtcaatagcaaagtagggctgaaaaggcaagggggcaccagcagacttggccaagtcctagaccatggctcctcaagcaccaccctctagccagcctccacattcagccaccctgctcagtgtgttgatgcattgattggcactctcaggaaatcgggtctggctcactaagtctgtacatcaccccagatctggttcttcctctcatagagtcagatatcccatcaccttcccactcagcctgctggcctgcacagtagcctgttttctagctactcagtttagtcctccaatgtgctccctttgttttagattccatgaatatcctggaccctgaggatgaggaggagcacactcaggaagaggacagcagtggcagtaacgaggatgaggatgatagtcaggatgaagaggaggaggaggaggaagatgaggaagatgatcaggtgaggggggactgcgtttgggttggttcagatgacctcttccatgggaacatagagctgcagaaaaccaacagtctgggttgctagcctcagcgtctccctccctcatgtgcacatgtggccatggcaccaggcttcagaaaacccttacctccagcaattctccatctcctattttcccttaaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctagtaagatacaggggctcagctgggtttttctctcttgattcttatacccttctctagggtaagccaagcagtggaccaaaccgatccgatacagacagcacttcttttcctatgctgacttcctggggcaagggatatctgaatccatctgtctcattagtgtatacttaggagaaggaatagtgagaggctgcttttgttcccttcacctcagtaaataggcagccattttagagcctggacaacttgatgatttgcttgattaaaaaaaagaaagagaccaaggctgactgcatcaggcacccatgtgcacaccacagtggcagggcaatcaataatccttatgtccataacacaagatcttgagggtttgaatggtcacctttgagcttggctttggggagcagatttgaacatactcactctattcatccaggatgcgtcttttcgggagaacgagtgaatctcttcctcccccatcaccgtgaaacttcccttttagcgtcaagttagaatcgagttcttagaatcaagctgtcttgatagggcaggtcttgacaacttaaatcacaagcatgatgtagcagaaaacactgaactgttctggtctgttttcttggccaattaatctcttacctctttgagcctcagtttgtcacctgtaaatgaaaagttcgagaaaaaaatgggttggattagataactttgaagataacatctatgattattttgcatttttgtgattttcatcagtttcccttagagttgagcctctgtccattcagcaaattgaacaatatttgaggagtgcctactgtatcctaggtactagggatacagcagtaaagaagaaaacagtcctcgttcctcataggagtggtttattaggaatcataactaagcaggcattacattgcactatagtaagagagcacagaggtaaagagttacctaacccaatctgtggaagtcaggcttcacagagaaagtgacatcttaggccaagaagagaagagcaggtaaagaagcgggagaggagtcttcaaggtgaagggagcagcatgtatctgaggggcctagaagcatcactgtgactgtagtgtggaaaatggattgggagaaggtactatttaggaggccgttgcagtatctaagtgagagatgatggcataagctatggtagtgtcagtgattgtagatgagttgtgggaatgagggagaaaggacaaagctcaggtttccgtgtgaggaagtaaggcccaggagacatgattctgcttgaacaaacatggaagaaatttctttttgacactgacccttttacatattgtccttgcagcagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggtgagttacagagatctgttggattcatcggagctcttgtaagaattttcactgtgctttagcattgtcttaaccttgggggaaatagtccatcacttaatgttcttgtcatacacacaaataaggtatttgttccatttctttgtggattacatgtgtagccttttggggagtgcagccttttggggaataccaaattatgtcaatagttctgcgcatgtatttagcaattattaagtgtctcatgccaagcacttaacactttagatatagacgggacaagatccctgccctcaggcttagagtttagtgagacaaacaatcttaagaagtaaaagaaaggcatataagtgttgtaatggttggtgtacagacgacagagagggtgtagtggaggcaatgtgacctgacgcagtgcc

SEQ ID NO: 137387 - DNA, 1046 bp, Homo sapiens
ctttagggggcttcagattaccgcttatcaaatgagaaaatacttatctatttatagatttgctgtaagtagttctattaaatatcacatgtgaaaatattttaagataggtgcaatagcacatgcctgtagtctcagctacttggaaggctgaggtgtgagaacacacacacaggagtttgagactgtggtgtgcgatgatcatgcctgtgaatagccactgtactctggcctgggcaatatagcaagacctcatcttcttaaaaacattttaataaaaataaagtttttaaaaaatgtttttaaaaatacatgacatctacataacagtgtataagctgtgcagtgggaaatgggtggcatttggaagttttctaaaatctgggtttgctccttacttgcttgtatctttgagccttggcttcttcatctataaagtggacctaataatcactcattgggtgacttaaggaaatactatgtgtgtgtgtatctttggtcctgtgcaaatgatatggcataattgtgcttgtaagtaaatgtcgtgattcatgacttttcaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggtaagattcatacctgtcccagggctaatagccaagaacatccccttattcttcttcttagtccatgggtggttttgcacttgaacaaaacttcttgtcatactggcatcatatactctctggtccgctcaaatagttctggcggttggaaatagccagagcactgattaccattagagtaagtgggtaaacctagagaaaacaaagggaaatgttaagtgtacttttaaggtcttcaaggaagttgagcaggttatttgatcttatattt

SEQ ID NO: 137388 - DNA, 1060 bp, Homo sapiens
ttgtggatcacattgtaattttatggttagtaagtggcaaaagggtctgagagtgagtaggggcactagtgttgccatctttgaaagcaaccgccatttttaaagctattcttactttaatccaagtttaatatacatagaaaaatacacaaatcttaaatagtctgtttttcctaggtaaccactagccaagttaaataaagcattacaagctccctagaagctgccctccttgttctttagtgcatctcctcccacccatttcaccttcactcaagataaccattatcttgagttctcgtgccgtaatttggttttgtagttcatgtaaatggaatctcatagaatgtactctcttttttgcctggcttcttttgcttaacatacttgattcattttgtgtgcaggtgaagtttattttcatctgtataaaattccactgtggaatgtaccatgtaccaaaacaaatacatcttttacccattctactgctaataaacatttgggtaattttgcctttggagctatcacagatagtgctgctatgagcattcttatgaatatatataagttcgtgaactacccaatttctgttgggtagtatatgcctaagagtaagaattgctgagctctagagtatgatagttgttctgctaatgctaaaagttttccagagtggccaggtcagtttatattattaccagcagcatatgggagatcaacagttggtgttttttcattttactgattttaatgggtttgtagtggtattgcattatagttaaaatttacatttccctgttgaccatttttttcatgtctttattggccatttgttcattctcttttgggaaatgtctattcagctcttttactctattttcctattgagtttttaaaatatattctggacataagtcctataaatacataaataggcttcctttttttaagagtctcactttgtctcccaggctagaatgcagtggtacaatcatagctcactgcagctttgaactcccaggctcaagtgatcctcccaccttagcctctcaagtag

SEQ ID NO: 137389 - DNA, 1048 bp, Homo sapiens
tgagctgaactagataaaagtgtgccaggcagacggaagaaagaagtaagggagcaagacaagtttgaagaactgttagtagagtgtttctggagtatgtaaaaggagggaaatggagggagatgcacaaatagttggacaaagcatccctgttgtactgtaaccacataaatctgagacctgagttatcctggttctctgctcttgcactgcagtgtcacgagagcattcagtttgtacaggtggcttaaagtggaggagaaatagcattcttttccacctaagacttgattttgccagtgttccagtgtggaattgaaccagtgtttgacttttctcaacagcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggtaatatttccaacttctatttaagatgttacactgtacttccatcatttgggtaccgcctgtgtcagacactgctgggaagctgtgcatgctaagtgctaacccaagtaatgagtgagaagaggcatcttcagacatgcaaggccgggtgcggtggctcacgcctgtaatcccagcactttgggaggctgaagcaggcggatcacctgaggttaggagttcgagatcagcctggccaacatggcaaaaccccatctctactcaaaatacaaaaagaaattagccaggcgtggtggcgggcacctgtaattccagctattcgggaggctgaggcaagggaatcacttgaacccaggaggcagagattgcgggaatcacttgaacccaggaggcagagattgcgggaatcacttgaacccaggaggcaaagattgcagtgagccaagatcgcaccatcgtacacctgcctgggtgataagagcaaaactc

SEQ ID NO: 137390 - DNA, 2024 bp, Homo sapiens
atgttttcatactcaagcaaaacctttttattgtctgaagagctggaggcaatattaggaggtgtgtctgagtttcctaactgttgagaccaccacacccatccacctttattcctagttaaggtgcatcttataagcattaggaaagtcatgattgatttgcttggaacataggtttccattatagtaaggtccttctggattttattcaggacatacttatttgataggtccacagaattgccaaaaattgatgaatgctgcctttaataagcaaaagaaatctgagtcttgaccttggtgcttttcatctgtacagaaccctgatccatatagaattccttggttctcctatcaccccagaatctttaccctatctcttatcacctccccgaaatagtttagctatatagctgtggcaaccatttattgacccaccactgcatgagcaatagtgccaggtatgttcacttaaggtttgtagttacagcttaggaaagtgagactaagttaattgcctgtggtcacaagactagtttttgtaattttagggtgaggcactctaacattatctgtaatagcaccatgtaaacagtcatagccacttgatgtgaaattgaccaagactgactagataggccttaacattgtccaattgtagaagaggtttattttgtttttgatggttgttactgttttcctagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatgtaagtcaattccaacagcgttttatctttcttctcatttttcaatgcctgtgtggtctcagtatttagggctatccccggggaatttcaaagatattaattgtgatgtatctgtaaattatctgttgcctgtaaagacaaaattggggtgtccctggagacttttttttctctcctaggattagaactgttctttaattttttttcttttccctttccttccccgcctcccccacagtctcccagtcactgtatttataatagcctcccacagattatagtataaaggtgtaaggtggttaaaaggttggccaaagagaatctgtggcattcccagccagtgccctgggaaggagttctgccatttgcagacgggtgcttttgaaattcataatagctcaggagttttcttcttcttcagagtcaggtctttgctgcagatggtgcctccactgagacttccgcatctgggacctcccaaggagagggtaatgatttgcttttctcactaccatgttcttattccttaggaaaacaacttgaaaaaactgtaggtgtcctgtgcagggggtaggagaatacagacttaattattacgtttactggtctaagtgaactttctcaggtgagctcagtgttctgtaataaagggtctctatatgctaaagttaatggaactgtaagttaaccaacctagtaatggttgctgtggtaacatattttagttttactttttaaatcacaccataattatttggggggtttctaaaaactggcttatagagattttatgccagtgatattgttctagctacatgctttacgtggtggatgcctgtcttccagcaatgttaacagagcccattgactactcaccatgaactagaaaaatgtccctgggagtaagtctaatgagacctttaaagagctgcttctccttagataggaaaggtctttgtgatccaatttaggagacattttgtttaaaatcatactagttcctggagataaatttaaaaggctaacattagtgaaataattggttaactcattttactgggtttactggccatatgtagtgtatagcgtggatgatggtgctgattcaagggaagcattacccactatgtggcagactatattggacaccaaaatggatcagatttgttccctg

SEQ ID NO: 137391 - DNA, 1062 bp, Homo sapiens
gcaggctgaggcaggagaatcaggcagggaggttgcagtgagccgagatggcagcagtaccgtccagctttggctcggcatcagagggagaccatggaaggagaccgtggggagagggagggagagggagagggagagggagaggagggagaggagggagagggagtttttttttttttttttttaataaaacgttgggaaggggatgaaattattttggaagttccagctatgtgcctgcccctgtgctgggcatttctcagttatatcctcatttaatcctcaacataaatttggagagtgagaaaattgaggtttgttgaattaacaactggatttcaaaaccagttttctctaactcaagcctttactatttggtactgctatattaaatcctgtggaatttaaggaaagtataaaccaggttttatagtagagtacttgaacattaattgaaaatggtctcctatctcaagccttctatatcatacatgcccccttctgagtctttattagtaacctagtttaggtactgcttcatgattgactggtttttctctctcattttggcttagcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaaggtatgtggctagcctacctcaggaggctgggcactagaggatatgttactttgcctgggtcatttcagccaactcatggcttagtgagcactcactatgtgcccatactctggggctcaagatgaataagatacccattgcatgtctgtgaagaagctaatagtcatatagtatgacataccaggatggtggtaagtccttagggtgaggcaccttacctagtgagggtgcacaggtaagaaaatttctttgtgtacatgatttctaaaatgaaccttgaatggatgagattgccagagttctgttatatgagaataca

SEQ ID NO: 137392 - DNA, 1826 bp, Homo sapiens
attttcttcgtgctttcatggatttttccattattaacaagcaattttatgagaagagcagaagcatagctatatgtaagccctgtgttatcaaggcaaacaatatataaatagttcagtatctccagtggctatcattatctcagactgatggttgactttgaggcataaagaaaatatttaattgtgttcctgtacactaagtggattacagtgttacatgtttttgaaccattctggtttaaaattgtgacagcatttggagaggctcaggagctgacattttaatgtggaagttatgtggggtttatagtcttgacacatctcccagtttctataaagatcacatgcagtctggtctaataattgatagttttgagacatgctgcaacttttttataagccaggttttttgaatcaagaagggatgggacgggacttaaaaataaaatgtcattctccccaaaatcaaaagcttttagtcttggtaactcttgactgcagttgtatttttagaaagtagtgtttaatcgacagtgtttctttctctctttactaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactggtaagtttcgcttgctcctggcctttgatattaagtttgtggcctggtataaatccagaaatttatttatgaggaggtctgtaacttgaagagcctccttaggcaagtattaggacatttgctggctaattgattgtttgggtcaatttattaggtacttcagtagcttctctgggccttgccctgttgtaatccctgccagagacactgaggactcattcattctagtccttcacttcaaagagctcattttggtggggcagtaggctttacatatagttaatggtttacaaatcaagtgataattaagggttaaatggatgtatgtctcgtgtaacacagtgcgaaatagacgtcatctgtgtattcctgccaagaaatgtttgacctgtatttaattatgaggaaacaattagataaatacaaattgtgagatgttctatataagacaactggcctagactcttcaaaaatattaatgttatgaaagaaaaaatacaggatcatttcttatagagaaaagtagactagagagataatcaccaccagccttggttgggctgtggatccagataaaagatttggagaaatttgagtgctatgtattaggtaatgtaattgtatctgttaaatttggggggtattataatggtattgcagttctgtataaaaatacccttgatctcccctctgctgacttttttggtaataaaaaagaaaatatatgtccttgatcttaggagctacaagtagatgtatttaggagtagtcacttggtaattctggatgaaaagtatatagatgtttattatactattcgaacttttctgtaggtttgttggatttgtttttttattttattttttttttttaattttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactctt

SEQ ID NO: 137393 - DNA, 2501 bp, Homo sapiens
gaagagcaagaggtgtccaaactcgcttttataaccaacccagtcacaataactaacccagtccgtggataatgacattaatccattcatgaggggcggagtccccatgacctaatattatcttttattaggccccacctcccagcactgttaaattagggattaagttttcaacacctgaactttagaagacatgtttttaagcgtgtagcagagagactaaggaatgtgagagtaaatgcatatgaaaaatgttcttttggtttttaaaatttattgtccagtatatttctttttcctgggtgagttttagcagtgaacactgatgaagttactatttcttctaatcaaccttgaaagaaatacaaagaaactttgtacttttatgtttagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggtacatgctcactcaccaagcttgtctaacccgtggaccacaggccacatatggctcaggatgtctttgaatgcagcccaacaccacacattgaggtttttttgtcgttgttctttttagcttatcaaatatcgttagtgtagtttatgtgtggcccaagacaattcttcttccagtgtggtccagggaagccaaaagattggacacccctactgtaaactttatcaaaaagaggggtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatggtatgtaccaagagtgttttacctaaagctaatgtgcctttgtggcttaaggtctggccaatttcattgtgagttattttcatcagcttgattaacagattaaagatacgtaggcctcccttatgctttttcatctgatcttaaaattggtatttggcatgcttctcttaataggacccaagtgcttggccaattacttaggagggaggcgtgggaggaaataaacatcaagttaaactgtctaaaactgttattttcccattttatagatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggtgagtgtgttttgtatcagattctggtttagctttacatcatacctatgttctccttggtctgagaacaaatagacttctggttcttcttagggtatatagctagatatgtatactgtatactccacccaacagaattttccaactctatgcttgggagcttgcttaggtatggtaggatgatcctattgctagaaagtcctctccagcaatctggttttcttttttttctttttttctttttttttttttaatctaggtttcattaaccaagccaaaaaccgttagtaaagaactgggataccttcccccaagttcataccttcagaatcattcctttgtaggagtacctctcgggtgttcagccaagagactattctcaaaacactgtattttggaatataaaagtatagttaaagctttttgaatgtttgtaatctgccaggcactgtgatagacacttaacaaatatccatt

SEQ ID NO: 137394 - DNA, 6450 bp, Homo sapiens
gagatggagtctggctctgtcgcccaggctggagtgcagtggcgcaaactcaactcactgcaaggtccgcctcccgggttcatgccattctcctgtctcagcctcccgagtagctgggactacaggcgcccgccaccacgtccagctaatttttgtatatttagtagagacgaggtttcactgtgttagccaggatggtctcgatctcctgacttcgtgatccacccgcctcagcctcccaaagtgctgggattacaggcgtgagccaccgcgcccagctggtttaggtttttaagactctaaaaagtaacggaggagaggcggaacaaaagaaaaaaatagtatagctgaaaactgttggacagattagacgtaatagctctaagaagagggacgtgtagggccaatatagagattggggaccttttagatgtaaaccccccttgccagggtaaaatactaatattctgtctacttttccttatttgaatttagaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagtgagtattcagtattctaaaatcaaaaggaatttctcatgctaagtcgttcccactctattttgtcctgcttaatgaaataacatgcttatttaagaaccactggatccaactcccagatagggctgccttacgtaagggaatatagaccatttgagaattttccgtgataaacatttgagctgtaaatttcagattggtacttgcattaggccgttcttgcattgctataaagaaatacctgagactgggtaatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaattgggaggccagaaagaggagaggggaaaggcatgtaaagtcctgccacttccatctcaaagagcattttaagattttcttcctggagtttgtatgtatgtgtgtcagcttttatgtctggagtcctgttcaaatctgtctactatatacacttgtcccgttttttatcattaaagtaataaatactctcattaccaaatttggaaaatacaagacttttaaaaggcattcgtaattttatcacacaagatagtcattgtctcctttttcagtcagtcttgtgcctaatttttacgtcgttaacatcaaataatacatatacttgtattgctgttatcaagaacttttttttactaattggtcattcttttattgttggatgctaattttcttacagtttgatgttttaacactgtgttgtatagtttccttacgtaccaatccttacatacatctcatgattattgcctggtagtagattaactaggtcagtttttcaggcacttgctctgttaccagtttgttttccagaaagttgggaccaatttatacttctttgtatgagtctcaatcttttaattataataaccctgttaatcataataaccatgcatccccccctaactttcttagaggatgaaatcgagaatcttcttggctccttacccaatgtgtagcttagaatgctatagaagcaccaaacagaaaggattgttcattttacctaattgccctagctcataaatgctctcagcccagatgaagttagaaaaagttatttccatcttgaaaaggttccttccttttaaaaatgtatttggatttccgttatgtgattctgagcccttgcattctttatgtagctcatggacatgggcttcacaagggaacatgcaatggaggcactgttgaacaccagcaccatggagcaggccacagagtaccttttaacccaccctcctccaatcatgggaggagttgttcgggtaagttggctcagaagcagtgattttccaggatattggtttgactgctgaagtcctttttccccttattattctgtcattggtcttcctttctataaactgcttctcattttcagacatgtccatgccagtattttcttttcataataacagaagttttctgtcccccagcaatacaaattactatactttgtttgcacaagaacccccagtcacaaaacaatagaagaggcacacttttctaagatgtagaatagatgatcacactgtaagcctccttcctatacttagttttacgtgtgattttcctcatctgttcttgtttgtagtaaccacataagcctgatagggtttgacttatacaagagcagcattttgaggcccttcctctctctttagcttgagcacaagatgtctgattgcctgtgagttgcagtggtcttgttgggtttctttgttttgagtgtgtatccttactggatattctcttaacactctaggatctcagcatgtctgaagaggaccagatgatgagagcaattgctatgtctctgggacaggatattccaatggatcaaagggcagagtcacctgaggtaactatggaacactgcatcctaaagggcttggcacatgaatcttagtattctgtgaacattctgctagtattgcaaactaattgatagaattcaaatctaaaggaagacatgagaagagtactaattcatcccagctttgccatccattattgagctaccttgtattgacctgaagctttaagggaggcatatgaagcgttaatctttattgtcaaataagagacccaatgtgtactcagtagtgccattaggccgaacttggctgtatatttctaggtgacagttactttaattttccctgctggcacagaatatagaacagtgtctagaaatgattttgcgggaggtagtatagaatgctacaagtgacttgacagtgaaagttgtttgaagcatccctcccttctaccttccctgtcttgccttaaactttgtggctgccacatcctggatgaaagtatcaaccgcttgaggagaaggttgagggtaatcatatggtagagcaaaaacattctcagagtctctcttatctttcctccttcacctctcctgtgtattattcacacttccttccctgcttccaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgagctctcaaggggtcagaagaggggagtatgtgaagtggtttgcctgcctgtgtcaaaacctgatttctgaaaaatcagcatattttcattctacctgatatgggtatattctctatttggattctttcgatctggtaatcctgaaacagtgtgttaactacatcgcacacacaaaaatgtctttagaagggaaaaacaaagctctccttttctacttttctcttaaaatgtctaaaatgtgcctcacccttgagtcaggttcgtcccctggactaatactgaataaatgttttttcctatgtaacagccgcttgaacaactgagtccccatcctgatgaatacttgtgacctgatatttgtcctctttttcttttctctcattatgaaattatgctaattatagaagtgggataagaaaggaattaccttaaatccccacacccagatagccagttaacatttcgattgtatttaagttactggaatcttgttttatgtaatgtttcattctagaagcagggaaagaaattaaaaaagggaaaacttttttctgggctttgtaaaatagaactttaatgcacaagaacacaagtaaaggaaaactggataaaacattttttcacagaaagttttagtgtctattttttaacaataattctgagagagagagataaaatgaaagattgctgatggaagtataagttgatagaacctttttggggttgactgtatgcaccaggaagttttaaaatactcatttcctttaacttagattttaggctgcttatagtctagcctaataaagtaattgtttagtggtgatcctttagtagcatacatcttttgatatagattctaaatccctatggtaaatatgttagatttacctacctttctttagtgaatgtgttggaggcagagggagtattttaaaaggttgagaatattttcagaaacctcatcttgctctgcggttccgtgacttaaccctttttttgcttttctaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggtaagatttagatctttggggccttgtaattcattcatgaaagaattatcaaacacttaacatatatgaggcattgaagacgataaagcgaagaataaggcatgagtcctgcatttcatgagcccagtttctgataggctgaaatgcatataattacgtataaaatacagcattctgtgttagaatgataacagttttatctgggtttaggaaagtcatatgcatcactttggattcatgtgagaagggcttctgagaacaagcattaattgaattgagtcagaattgtgaggtggtagtttaaaaaaaaagtatttaaattactaacagagcttggtcatagaatattttttgctcttctgaggaaacctaactggcagccacatagtagagtagggtatgcaaattggatgtggtcaatattgaggtaatagacattagatgaaatcagattcctctctcttttccttgcctatttagtcagcagattatttgaggcaagagagtggtttgggcaagacctgatccaaccaacgtaggaactaggaggcaattgaccttggacaaatgacttcatttgtggctcattatctttaaaacctgaacttaatgaactgaaccctttacatacagcaaactcaggggataaatccaatataagagtcaaactgtgtaacagctgtcttgggggtttcctttatcatggaagtgataactcttactgtagcactttgt

SEQ ID NO: 137395 - DNA, 1144 bp, Homo sapiens
tgtccataatctgcccaattccttaagaagctacttgtaaaaattttcctgcttttcctagtttattttttcctctgggactacatattttttgttgtgatcagactatgtatattgtcagtgatcttttcttatctaagtggctaatcatttttggcattttaaaagttttctgtaggcattttaagtgactttatcatccactagatatcatttaacttaaatatggtttcaatttatgttcctctagcagtatgagtgcttatttgtcttttacatttggtatctgttgagtgccacatatctgtctcctaccgtcaaaagtggcatttgttccttgtgggacttcctttttggattattgaatgtagaacaaatccaagtgttaactaggggttgtaggaggaagtggtgagtcataaaaatatgttaatggtaatatgtctgttgtaattaaaccattctgagaatactgtacagtcttattctgatttctgggtttcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggtgaagttcagcttgagattcagggactagaaagttacaataaaaaatatgtaagttgttcctatactacttaaaatggagtgtgagccactgaatttgagaatttggaggtcccttgtttactctagaaaatgaagtgtaagttacttgttttggttgtacctagtacagaacatgggtaatattttaagtatttacagtcaaactgcatttcagtggtcttatataggtagtatcccttatccaaaatgcttggggccagaaagtgttttgaattttggaattttttgggttttggaatatttgcggaatacttatcagttgagcatctctaatctgaaatgctcccatgaacatgtactttgagcgtcacgtcagcaatcagaagtttcagattttggaacattttgaattttctgata

SEQ ID NO: 137396 - DNA, 2372 bp, Homo sapiens
aaattagattcactgtcaaagaattgcctctctaacagatatattttttctagcaatttaacacatttaacaaaaacgactcagcttctccacagtttttctggaatgttaagagaacaacttggtgacttgttttataagtttgcataaagctcattcttagatctaagagcaagcatataccaaagaaaaagacacatgtcacattcatatacataattcttaaatgctaggaaataaaattgtccagtggtaatctgtgatgtctagtttgaacttaacaagctataacattctagtagggcatccacattgacagcattgggtactgtgcacactgtagtccatgtgaatggtaccccctgggttgggctgtgcctacaacagtcttccaaggtagccctgggttaatactattcatatgctgtcatttgaagatgtcagcattaggtacttagaactccagaggagcatatcagtaaaatatttgggtcgtgtttttgtttttcaaatttaggaagccatgggaattgaaagagtaacaaaaaccataggtaatcttgtcagtacttctcaaggaaccaggtaaatgttggctctacattgtcctattgctcccctcttatacatctgtagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcaggtgagtcattctcctttctcctaccttttctggctttcagtcccttagtcttgaaacagattgagttggaaaggctatgttgtttcacctaaggaagtttaaaacttctgtgactcatttttaagtgtcctttgttgagtggctgctatgtgacaggctttgtactagctgctacggatacagacatgacagaatcccttcctgagagccatatctactaccctcccttctttaatttcttcctcctacttactcttcaactattgcatattgttgctgctccttccatttcactgagatgtctcagcaaggcatctacaacgtccttgtcctaagtcccttctcacttgtctgcagcatggtagttgacccaccatctccatctagaaatattcttcctttggtgcttgtgttattaagctatcttgattctcggataactatctggctcttccacctagtcttctctttttgtgttccttgaacataactggcaagagacatagtctgataggtgttttatattaaagtcactttggcagctttattgagactgtattggcagcatacaaaactgcattaatgatttgcactggtctgtttgcccttttttttcccctttaatgtaataccaatgtttgggaacctatttgtgtgttcgtaaattgtcgtcactttctggcaccttaatatagaggaaaatggagacctaacttagaggaatctggggcccttcgtaaaagcaaacagaaaatggcctttggtgtttccatttgttacctcaaattcccattgcattttacattttacttttaattagtttaattctccatttattttaatttgaaagtctaccaacattaccttcaaaggaaaattgaccaagcaagaagatgttcatatttctctctccttgctttgtcatatttctttgatcttggagcattcagaggtttctgtgtgaacccagtccatatactgtttctctttggttactggccttttgccatcctcttgtctttggactacctttaagcactttgctatctgttcacctgaaagcagtggtgagaaagtgtaaacccaatgattggattcattaggttttcaaagtctgggtatacccatatctgtagactattccctaattaggataaagaaatcttaatttggatgtaataggaagaagaaaggactgttttccttgttcctatactgtatacatttgagcttattactaaattttagcaggatatgtaacctaggctcaagtagagcctatttttacacactgagtttatatgtgcatgtatatcctgaaaagacatagatttaacccttgagcaacatgggggttgaggcaactcctccacacagtcagaaatccatgtataacgtttgactccccaaaaacttaactactaatagctatctattgaccagaagccttaccagtaacataaacagtcgatggacacacgttttgtatatgtattatatcctgtattcttaaagtaagctagataaaggaaaatgttaaaatc

SEQ ID NO: 137397 - DNA, 1574 bp, Homo sapiens
aactctaagaaactaaaatgttagtcattacttctaagttttgttcctacgtctttataggtttattatgaaaatttttagttagttctatcatccatagtctagttttcatcctctcactaatttttagtcatttcttccataaaaacatatatacataatggtaaaatttagaaaatgtagttgaaagaattacccgtatttctgccaccaaaaaaaaaaaaaaaacattttggaagtgtctgcccgtcttttttctctgaatacatttgccagtgtcttagataaaaacatttcgtagatctctttcttcacttaatgttaggtaccatataaaggtacacgaattaactattccctgttaagtttctaatatgctatttttaaaaaatgaacatttttgtatctacttttctacaaatgtaaaattgattcctagaaattactgtatcagagggtattaacaaatactttttaatgtggctactagaaaatttaaattatatatgtgtttcatgttatatttctatcgacagtgctgttttataaagaagattgcttttatattatctcatgataaaaattccaaattttggccgggctcggtggctcacgcctgtaatcctagcactttgggaggctgaggcgggtggatcacctgaggtcaggagttcagaccagcctgacgaacatggagaaaccctgtctctactgaaaacacaaaaaattagccgggcgtggtggcacatacctataatcccagctactcgggaggctgaggcaggagaatcgcttgaacctgggaggtggaggttgcagtgagccgaaatcgcgccattgcactccagcctgggcaacaagagcgaaacaccgcctcaggaaaaaaaaaaaaaaaaattccaaatttcagtaagtagaaatcatacacaattttctgactctaatgctacaaacctaaaatgaatacaagcaacttttccagaatgttttttctctggtgttcagtatcaatgaggaaataaaaaaggataaactattaagaaagcaatgaagataattctgtgtataaaaatgcatcaggccaggcacagtggctcacgtctctaatcccaacactttgggaggctgaggcaggtgaatcgtttgagcccaggagttcgagacccgcttgggcaacatgacgaaactctatctctacaaaaaaaatacaaaaattagccggccatggtggtacatgcctgtagtcccagctactagggaggctgaggtgggaggatcgcttgagcccaggaagttgaggctatggtgagccatgagtatacccctgcactcaagcctagatgacagagcgagaccctgtctccaaaaaaaaaaaaaggtatcaggcttaaaacttgtacagaaattactagaaagggaaatttctaaggaactaataaagctgacataggcttagaaccaacaaacaaggacttacatatgacagctggttattgtgagggatgggataacattaataaactataaagaaacctgacaaaatgagaatttcaaatttagtcaaaacatactaa

SEQ ID NO: 137398 - DNA, 8162 bp, Homo sapiens
cttaccacccaccactcatgagcagcttgaaagaaatggactatataaagtctttgtcatctttagaacttgaatagcaattgtctggaatttaaaggcaatgagtgcagagacgcagttgttccctgaaatgtggcccactgggagggctcctttgtcagagtcagctgtctcctcaaaagctggaggaagcacctgaccatccccccatcccaaaaaaccccatatacatcatactatgacactaaattgatatcctcctttacttttgatgggggcatgagctggggctccaccaccataaatactgaaaattgaccagagtttgggaatgtgtgtatgtttggggaaagggagagagacaggaagtttagaaggacttttcttgaaatcagttggtaagttgagtcctgttggaaagagttgatcattttgattattcctgtatggcttcttgggcctgagagccaaaagatgaggggaaggagaaaagtggttactgaacaaatttattcctgaaattatattaagaaccactattggtttgctttctctctgttcttctccccagtttccatgtagcaaatgaagggggcatataggtctcatttgattttactacttaggctctttgccattatatctggcttcttcaaagggttgggtgtctctgggcgggatccacacctgcactccttatcgatagaggtggatctatataggtaattgatataagtaacatggaatgctgcagtggttctgaggaggaacttaaagaaaggtttgtggtcttctcatggaatcatttcagtcttgccttataggtatactccctttctacaaagttcttccccacatttttcattgaggaggttcacaacatcctacccaaacctggttctgggtatttttgtcactgaagtcattcataatgcctctccactctcttttcctgttctatattctgctgccaaatgttcttgtgcctggcaaatctttgtttacattttgtcttgctcaaagatgagaactactagcttcttgccaactttcttgtcttcttcctctacctctccctctgtctctgccccatcccgctctcctgcaccctgtgcccaaatctgtttcaagggcctgtgtccaaaatactccattttctaaagtatttgttccttcctggggtttatcttagaggtatattttgattcatcacaatatactatatgtgtagttttttgcattgagctgcattttctgcagctgtggcatgttgtagccttctcatctgctgtgcaatattgaagcaactgaaaagacaaaagacctgatcagttttttgatagttcaggaactgtcatgctgcaaataccaattgttagggaagggagacctcaggtgtatgaatctttgaactaaattaaattgtatttcctactctccataactttaaacgtgatgcaaaaacatcgtatgatgtttaagtgtttctttgtctagcctctttcttcaagcaaatgttgagtcttttaattgaacttatttttagtgttctcatgtggataaatttccctaacagtagtttgccaaagataggatagcttctcttgtgatgtatactaatgttgagtttttaaaggcttggttgtcccctttatgctttcaaccttggtcaggcttggaaaggtagattcaggattgatttcagctgtttttttcctgcggtatatgagtctaaaggctcatctctaccccataagcctgggaagcaaaggctgcagtgagccatgattgtgccactgcactccagcctgggtgacagcaagaccctgtctcaaaaaaataagcaaataaataaataaatagaaaaaggcctagaattttatacagtgcctcctcctctgttctcttaatattggtattgtgaatttctgtgtaactcactcttttctcccctaacagggttgttggtacagaggaacgtattcctattcccctcatggattacatccttaatgtggtaagattcaacacagggcaaactgagtaaagatgtatatgtgcttttctggaaaatgtgtttcgttatcagagtccagtaattaccgtattcattttaattggaatccaattaagaggggaaagatgtgccacccttttgtttttgttctagactggtttgccagaaattagccaacacaagccccattattttgtattccagatttttttgttcactgttaccattctccattagaatccagacaggaatctgtaacaggttttgttttgccagtctagtacaggctgatcatcccaaatccaaaatgctccaaaatttgaacctttttgagtaccaacataacactgaagggaaatgctcactggagcattttcagcctgtactgtataatgcaaatattcaaaaataaaaatctgaaacactcatggtgcccaagcatttcgaatatgaaatatacaacctgtaatatgttttccaaatgtgtccaacatatattttcccccttttttcccattacttcctgggtatctcaccaaaaaagtgaagagtttgaattttcccagaattgtttaccaataagggagagacctcttagcatttgtttcagcctactaatcacttccaagacttccagagatagtttgtcttgtgcctgtgtgtttattgcccacattttacttttttactcttaaaaaaattctttgtttgaaacaaactcttccagagttcagtgtttcatttgcattatgcgtttcatttgcattataagcacatttgggggaaattttccatgatgtttgcctgcaggagagaggtaggcaaggagcactaaatagcaaattaagagattaaacatgattgtaccactaattcataatgtggccctgagcaagtcacttaacttctctgttatctcgaaatatctgattcttggtgtgcttgaaaatggagattgggcagaaattgtagatattctttacttcctggatgttttagaatccgtatcatacatctggtttatctgaggttttgatactctatagaaaacactaatatcatgactagaaggctaccccatccttattccaggctggccatttagttccacctgtcaggctctaacttctttaaaaaatttttattacctagatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattggtaagaagcatctggccaaatgttttcatttctttctggaaatcaattttgcgatacttctgtatatatgtttttactatggtctcccttcaactaaaaaataatgaataaatttgtgttatgttgtataagtgaattttgtgactaatatatagtgtgccatgttatttctcattgaaaagtcaaagtattttttctttgttcatcggttgggtatgtagttctacatcattagagtttattggagggaaaagtgtatctccaagaaagcttttctagttgggttttattagtacctctcccttctttgttataggtgcattttaaacacattttatgtttatggttatgtttaaccatgtattttcctcccctttcaagcttggtagtcatgtattttaagcataattgacatgtagttcattgccgatacttaattccccccttttcaagcccgatagtcatgtattttaagcataattgacatggtagttcattgctcatattttgccaaaaatgaagcttctttattttttcatagtggtaaactacacataacatgaaatgtatcatcttaaccattttgaagtgtagagttcagtagtgttatgtgtattcatattgatgtgcagccaatctccagaactcttttcatcttgcaaaaatgaaattctgccattgaacttctcatcctcccctctccccagaccttggcaactaccattctattttttgtctctaaatttgactactctaggtaccttatataagtgggatcataaaatattttgtatgtgcgaccggcttttttcacttagcataatgccctcaaggttcaaccattatgtagcatgtgtcataatttccttcccttgtaaggcctaataatattccattgtgtgtatataccacattttgtttatccattcatctgttgattgacacttgggttgctttctccttttggctgttgtgaataataatgatgctgtgaacatggatgtacatgtaactctttgagactctacttttaattctaattttcccacatcctagccaatacttattttctgttttttgataatagccattctggtgggtaggaagtgtatctcattttgtttttcactggcatttccctaatgcatagtgataatgaacatcttttcatgtgcttgttatccatgtatatatcttctttgtagaaatgtctattcaaattcattgttcttttttaatcgtgttatttgttttgttgagttgtaagagttgtgtattcttgtacacgtattaatacctgatactaatttcttctcaggtatatgatttgcatatatttttcctgttctgtgagttgccttttcttggttgtctttggattcacaaacatttttaatcttgataaagttcagcttctctttttttgtttttgttgcctgtgtaaacacctgtgtttttggtgtcgtgtccacaaaaccattgccaaatccgatgttttgcagctttcccactgtggcttcttctaggagttttataacttagctcttatattcaggtctttaatccattttgattagattttttatatggtaaaagtctgtcctttcctattgcatggtcttggtacctttgtcaaaaatcatttgaccatatatatgtgaagatttaattctgggctctctattctattccattggtctttacgtctgtctttatgccagtatcacagttttgatcactgtaactttgtaatagaaatcaaaaagagtgagacctccaaaaatttttccccaacttgttttggctatttggggtcccttaagatttcatataaattttagaagggatttttctatttctgcaaaaccaaaacaaaaaacagcattggaattttgatagtgattgcattaaatctgtgaaactcctttgttagctgggctgcagagtgataagtaattcctgctgaatgagaaatccatttgcttacagacttggaaagatccataattgtgacgtgacttcatttagtttattttgttttactctttgaaatattgaattaaatgctcttcatcacagagaggggaaaatatcctataagatgctgtggaaggatagatagatttatttaaagccataggaaggcacatgatttctcctatctttgcatggcaagtgatggtgttttattgtcagatttttctccagacttgagaggaaatcacaagggtcgtataatccttgggttgtctgataaaaacaaattgcctacctgattcctatctcagaataatcgcttttgttttaagaagaaaagaacagtgtaatagtgactcacttccatgctttggaactttgcctaacattgtttcctatcgagcaaaatttggaattaatcctatagtgtagaatccttgccgtaacagtattcagtttgaccatcataagcttttaagtgttattggctcaccaagtttgaaagtagtgtgttgctctagaaagagatgttaaggtatgttgtacctgacttcatatttgggttccaccatttaccaggtgagagaccatggccatatccaaaatctgagaggcttccatttaattgtcacttccattgtgactattaaaagacatgatgaatttgaagttcattgtatattaacactttaattattcttcctgtttcagacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacaggtaaaaataaccttaggggtgaacatattaatttaaaggcagtgaaatatctagggcatacacctagcagggttactatgcttgaaaggaggtctgcctgaggtagcagctaaaagaacagtccaatttaggatgagatttttttgactgtcaaaaagttgagtgactatataacttattatgtgatgaagtggactttcttgagagcgaaacatgttattacagacaaacatcaattgggtattcatctggccttagtactttctaatctttccaccagtccttataggtctgataatgggatggcataggtaggacattttaccaaagaacatttaaatcaatagtaattaacaaattactaaaaattttctacatatcaaacgtttgacctgtaatccataatccatagttccagaaagaaggcattttgtgtatgtcctcacagttttactacatttattcctcagataattgattctaaagatttatggtatcaacattaaacaaaacagggttcaacagccctgttttatgctattgagcaggagtgtgttctctgttaattgtgaatcaatcaaatctgaagtttaaaaaagcacaagtataaaggatttagaaaattaaattacttaacaaagcttagggattgatttttatgacttctttattaaatgaaataaaatgaaaatgaaacattcaaggaattaaataaatctaggtacttactgaagtaaagaaattgaatggaaataataatacccctaccaaataatttagaaagtagttaatgaacctgtaaaaccatttctttgattcagaaaaaaagagtagcctctgatgcctttctttcactttataaaaaacaatgagaacggatgttgtggaaatagtttgtaaatattgtaagaggataccttgtggaactgtcgtcttgagtgtggacattttgatgaggtggataactctgagaatagcaatgaagaaaaatcccttacccttataaaactgttgaaggtcaatttttttttttaagtataattgttcagagaacatcccaaaggtgaaattcttgttatgattgcagagtgaaattcgttccatctccgtaaaccagtggggctctcaattgggtctgagtgttttgagcaagctgagccagttatactgttccctggtgtgggaaagcactgtcctcctctctctgtgtaccccaaacaggtaagagaatggctctctctcttattactttgttatctaagttcggtgagcctggaggattgctttggttggggataggagggtatggaagagagttcagaggcctccttgtccttccctcttcccagcctaggaacttgatgacaaatgctttgtcgtcatggtagatgtttaaaatgtgttcctgttattagccagatacaaaaaattgagttgtggctggacacggtggctcacgcctgtaatctcagcactttgggaggccaaggtaggcaaatcaagaggtcaggtgttcgagaccagcctggccaacatggtgaaaccccatctctactaaaaatacaaaaaattagctgggcgtaatggcgggcgcctgtaatcccagctatttgggaggctgaggcaggagaattgcttgaaccccggaggtggaggttgcagtgagcccaagatcatgccactgcactccagcccaggcgaaagagtgagactgggtctccaaaaaaaaaaaaagaaaaaaaaaagaattggaaagcttgtggggtgctacctcaggaattatagatgctttattacattcagtttaacctgcctgctataggagggatagtgtcagccaagcaaattagagaccatttacaatataagaggtgaattatca

SEQ ID NO: 137399 - DNA, 1322 bp, Homo sapiens
ttatatattatatggacaagcagacatggcttagattaagtttgtaaagcatattaccctttctagtctccgtttgttgatccctgtggctgccccccacccccgccttattagctctgccagtttccttttagaattgttgttgaaattggtatataagttcctggtgcttggtgaattgggacagggagtcaggttcgtcagtcacttatacagccgtgtgacgctcaacaaattatttaagtttgcagcacttctattcccttgtttataaaatgtaattaatgaccatattctgggaattatgtatataacatgtatacaaagtgtttgggcaaatacacaacacatagaaaacgctctaaatatgttagctgtctcctcctccccattccatgattactaataagtaatcttatttcctgtgcctttcagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcagtaagtgtttacagaacagatcatctagccatataatcgtgggcatgttatcacctctctaagtcttaatgaacactttcatctataaaaagcaagagagttgtattagatcattttaaagttctaaccggttctaagaatgtattagtttttccttttttgacccttgtgtgtcatttgtgctttggtatttaattgtattggttgccttaggaagtgatctttttttaaaaaaattaattaatttttaatttttattgatttttttgagagagagttttgctctcgttgcccatgctggagtgcaatgatgtggtctcggctcattgcaacctccacctcctgggctcaagcagttctcctgcctcagcctcccaagtagctgggattacagacacctaccaccacacttggctaatttttgtatttttagtagagatggggtttcaccatgttgaccaggctaatctcaaactcccgacgtcaggtgatctacccacctcggcttcccaaagtgttaggattacaggcgtgagctaccgcatccggccaggaagtgctcattcttaaaagctgttgatgaaattgaatcagaatttggtccatcaagttaatggactttgcacagagaccttattttccctttgttgatttgatattccacatcgactgctt

SEQ ID NO: 137400 - DNA, 1761 bp, Homo sapiens
agcttgcatttgctttaacccagcaagcccacatcatagattttttttcctgttaaaagcagacaaaaacggatatatgtttaggtttatcattttcacaattgaggactggtttttatacatgtggtacatgcatttagtggaatagtaggcagccattcaaaatgaatgggtcgttgtgtcgggagaggacattatacggtatgacagttgtgggggaaaagcaaaatatataaaacagtgtaacctcatttatgtaaaaatatgcccataaaaatcctgtaagtgtagtcactagattctttatagtattgaatctctgatggagcagtattaggatctttaatttcatagtaagcacaagggtttaaattgctagacattgagtatgtatttttttttaagcttttggtgttttgttttcagtttctgtgaggaatctctcagttttccatattttctcatctttttttagctactgaagtggtgactgtgtttgtatttcaagaaccatcactgctctcctcactccaggacaatggattgacagatgtcatgctgcatgcactgcttatcaaagatgtaagtcttttctgctactctgtaaagaatgtcttagggcgtgaaaatcctatctcttctgtgtgtagtgttgaatctaattgggacctggttgtcaaaattccttctatctcagcttgatacccatggccggattttcctagcatctacactcttttagatgcattcaagctcactttgttttctctttaggttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggtaagttgttaagatttattttatagtagaaaattgatttagtttgcaaggaaactcttccttgatcatctctctcatcgttttactggttaggtgtgctaagtttaatgggaattatcatcatacattctattatacttcagaaggaatacttcagcttctctgctcataatatttccatgcttctcaacagttcaccattgtactttcatggtactggtagaaaataggtattaagaagcagtggtagatttccaggttcaccatctggtctgcagcaatgagaaatatggagtcctgaggtgttcatctggtaatctagtgttctgatgtccaactctctaagataacgacacatggatattttttttttactcagtatacttgagaccagataattgagagattattagcaaaaaggtagggctccagaaagattacagttttcaaaaatgtgctttgtacttttcaaccaccactgtagcatttagacactatcattcttaactggagcagccagagggttaatggtttgtacatctttcttctctctcactctgtaatactagtttagatcttgacagcaaagattgccagagtagagtgcagcacacatagttactttaaaatagtttactaaactgattccttccttttccctagtgatttggggggataggggctgggtgtaaattcattaaagaagttgtggcattagaaaatcacaaccaaaaaaaaaaaataggaaaaaaatatcacaacagcctggcctggcacagtggcacacacctaccattttgggaggccaa

SEQ ID NO: 137401 - DNA, 1045 bp, Homo sapiens
ccctcattgagggcttcttaggcctgaactgtttggttaatgtggtctgtcaggagttacaacatgtctcggtaacctctatgagttgagtctgtgttacagaattggaaatacctaaacttgtgcccgttacaccaaagattctgatgaggcccagaataggtaaaaagtgctcctttttgtggcaagacttgataaaacagctagactttctagttgaatttgaggtgccctgggcactaaatgtccatagtacataggtcagcttgtatgggtagaagggaacaggatcgctgaataaaatgtataaccctgctgagcaggagttgtaacacagaagaatcagtagcccaagaggttggaagttggagtttctagggggcaaacttatatcagggtggacattctcaacaggggggcatcattgtatgtactatcagttggtggcagaggctgggaaagacatgaaatccttaagggggaagtttaatatggaagcacccagtgaggtcacgatgtcctgcttataatttcacactcaaacccactaaatattctgactccttctccctcacgtgtccgacctctggctcttctatgccacttttagccacctgtatttcatttgtagtatcccatttaacttccccaactcccctctcttctttctcacctcctgccttacccctcatgttatctgttcgggtctgtttgtagcctatgctaatgtcatcatgcttatgattgaccacttaaccagagagtgtagcaagttgtcaatatgagtattgaaatcctccaagggagcaagatatagttgtatgagtagttgcctgggctagggtatctgttagtattgctggaggtttagtatgtaggtggcattctctgttactaatacatagatacaatctatcaggttgagtgaggggaagcaggaaatataggtagtgactggaatagtgaaattagagtgtaaatagtgaaagtggagtgtgggctgtcaaagagttgatggggcagtggagttatgatgagttatgtg

SEQ ID NO: 137402 - DNA, 1842 bp, Homo sapiens
ggattgttaatttacacacacacacacacacacacacacacacacacacgtgtatgtatgtacgtattaatacatgcaactagtgatatattttcattttggggttcagtattcctgatcttcatttttatattcatttcacattaatggaagaaattttctcaaacaaaatttttctttttgtggtaccttttattctagtaagtttctttatcataacttgtactttagttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggtgcgtacacacatagatgtgcagtctttcagagtggtagagttattaaactattgaagaaggcggctttaggcagaacttaaatggtacatttggaggttagcatcccatgactattcatgctccttcaccattctggtgttccattttcttatattaacatgtctttcatagcattttatacttttccaacaatttgcacattgattatcaaaacagccatgttggagggcagataatatccaaaatgggaactgagtgaggtaaaaaaaaagttgaacctttttactttgtaatttttcttttttactttagacttttagtattggtaaaattaaaagtattagtaatttttccaatttcaaagcttaattaagtattcttcctaacattcagagacctcacttcgaatgtcttctaattttattatagtgtatttggatctcttaaaattttgttttatgtgcttgatcattgtggtttaatggcgaactcagcataattcttttgtctttcttcattgccaggagtccagtgtattccacaacgagcagcacttctgaaatccatgttgaatttcctcaagaaggccatccaagaccctgctttctcagatggcatacgacatggtatttgattccagataactttttttggaggatattttactctctcaaagattggttcttttcatactattctggcacctgttgttttacaaggcagtctttggtaaaggccatgccattttcaatagcttttagttgttttgtgtcacttttcctagatgtaagtgttgcttagctattttcataatgatttaccctttttttccccttttccagctttcgactctgtgcttaattccgtcttattacccctttctgactcttaagtgtttgtgttctttctttttttaacccatgttagaaagcctattgcatggacaaataataaaataggaggagacaactgggggccattagattagaattaacacaggctttgaggaccacagtgtgataatacataacatatcactcaattatccccactcctcacacctttccagactattcgtattctccataatgttcacttttcttttagtgatggatggttctctgcctacctccctgaaacacatcatcagcaatgcagaatactatggcccatcactcttcctcctaggtaagtggagttgatagttggttataacaatttgggataacctggcagagctctctctctctgtatttacttacttacttatttacttatttatttttgagacagagtctcactctattgcccaggctggaatgtagtggcgcaatcttggctcactacaacctctgcctcccgggt

SEQ ID NO: 137403 - DNA, 1385 bp, Homo sapiens
caagtttaaacacgaaattcattgatgtttcgtatacacattatatacgtagtcttaaggcaattgtatacaatatttcaaataattttgtgcattttaactgtgacctgtcacatgagatcaggtgtggaattttccacttctggcatgcaggtattcccaaagttttggatttgggaatatttcagatttttgaatcagggatcctgcattaatgttctctgtatatcaggcttatacttgtttgccttttggtttttcccagagggttagaaagaactcccagtacttccctctttgggtattaaactgcaaaactaacaaatactagattttcattgttgctctcaacagacctccatcccctcaagcagttaccagtagaatgacttatattttaaagtttggatattagcaactggaacttggttcagtcatcttattatatttgacacattatgtgtttaccttctaatttaataggagattaaagcagcttctttacgaacattaacatcaattgtccacttggagagaactcccaaactcagcagtattattgactgtactggaactgcctcctaccatggatttttgccagtgcttgtaaggaactgtatccaggccatgattggtaagttttgatggtgattatcttaggcaagaagaaacatttgccctctgcctttgtctttttaatatcctgcctgcttaacagcaattttgagcttgtttttgttctccctctccccacctcccttgtagatccttccatggatccataccctcaccagtttgccactgctctcttctcttttttataccatctggccagctacgatgctggtggtgaagccttggtctcctgtggaatgatggaagccttattgaaggtgctgtactttttttttttttttttttaaactacatggggaaatcaactaagggtgtagagatgcaagtttggggtgtttcacagtgagggcaaataatataagaaagcttatccagaaaaagttatacttaagtagaaggccagtttggctttctagttatctaattaacaatgtttaagagcagctacttccattattgagacttttatcatagtgtagaatggtcaggaggtcatgggttctggttaaaacattgccacatgttatcatgcctttacacaaccatagggaaaatatatgtcagggtactttgtaagttgtgttgtagtagtaatagcctttactatgtgcagggcaatgagcaccagcttttttctccctaaatatcttacttaatcctgcaaagtaattgatgtccccattacctcagaggttgagtcgcagaagtcatagaactgtcatttggcaggcaccaaaaataaaacacat

SEQ ID NO: 137404 - DNA, 2067 bp, Homo sapiens
tcagaaggctgatgataggtacaaggtttttcgtaggaatgttcttttccattctttagctggtttctgggccctggtatttgttctccatcctttcttggattcttattcattactgcttggcagtcttgcccctcttttcccccttgggaatagccacagtcaaaattgatctcttaaagggaaactggaaatttataagtatgaaatgcagaaggtttgggagctctgggctctgtccttttgattctgtttgaaaagtctcatcctatctgagctctgctctaagacaaacagttaaaggcactgtaggtactgaatgtactgcttattcttctgccacaataagttgaacaagtggctaggactttgagggaagatgtgggggataatgtttataatcagttgaaactcaatgtctgattctttgatgtgctttatacacagaaatatccacccagtgcaactacactacactttgaattctatgcagatcctggggccgaggtcaaaattgagaaaagggtgagtctgattcagatttgttctgacaaagtctacaatttactgtaactgggattgcctcttctagaactcctcagttaaatgaataaatggttttgagctacactgctgccctcgcaaactataaatatacctagcagctcctcaggagtgttaattgcatccccaactctgatagggttgggtcttatgttgggagctgccaaaagatgcaagtcccatccattatgaggcactgctatgacctatgtgcttttcccacagtctctgagaattccaacatgtagtatagtagtttggatggtgatggctcaggtttctctaattaggaagcctgcaaaagtctttatgtattgtggatagtgtcctgcttaaattatctggtcattttgtattgtttgaggaggtactaaagagtttggtttagaagtagcttagtgaaaatacaatttctcttctacctatactattcaataaataaataatctttctagcttaattgccttgaaagcaactctaatacatattcagagagaaaatattttcatgaatttggtctttgctattaatactgctatggatattaagtcagtggagggttaaaaaaggacaaagaagaatatgaaatgtgcctggctatgtgcattatagtttgatactactggttttaaaggagctttcctaagaatattctacatataagatggatgttttggaagattctcaatttaccttgattttaagagcattcacttaggcttcagcctattaggtgacatcttggttttcagacagccctttggagctctatggaaggggaagctagagtgttcagtgactccttacagctctcttgtcttttttaattttagacaactagtaacacactacattatattcacatagagcaacttgacaaggtaagaggaatctttgactcttggctcgtttcttaatgtttggttcactttttgttcctaactatatctttttttttaatgtagatttcagaaagcccttctgaaatcatggaatctcttaccaaaatgtacagcattcctaaggataagcaggtatgatgtggctttaaaacatccacaggatgtggttgttatctaaatagattaatgatatgtactggggtgggagattgcatagcagaaagaatgtcagctttggagtcagaccatgggcaaattgttagcttctctgagccttagtttccttgtcttttatgaggttaacacttaataacttcctaggccttatgagagtttgaggaaaacataaactacctcaccgtgagcaggtaataagtggtggtagctttctgaacacttcggatatcaaaggagaaaacgtttagttgtgttgttttttgagttagccctcataaagaatattcacctttttcattgatgtttttaaaatgtatgtcttatctctctacagatgctgttatttacacacatacgactggcccatggcttttctaatcacaggaagcgattgcaggcagttcaggccagactgcatgcaata

SEQ ID NO: 137405 - DNA, 1186 bp, Homo sapiens
tagaatctgctttgtaactcagctcatgtcaaaaagagaggaactggaaagcatgatttcctccctagtgctttcctccctagtgcggaaggtgagtaggcagagcctcaggcaaggcctgataggacaggagggacctgtcagcacacgtgactacaggggtatggaatataatggctggcagttgctgcttgagttcttcctaggagcatcctcactgaacagtgaaattgatctcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtcttgtcagtttgtcgtgttt

SEQ ID NO: 137406 - DNA, 1621 bp, Homo sapiens
aaaaagtaccctagaatcttaacatttaatatgttgattttgttggcagcgaaacaaacttgtcttcctgataaaaataggtgcttggtgttttatgtatgcaacaaaatttatcataattgtgtatctactcattttggtatattttcttagtctttatctgatgaatatttcttcacaagaaacatttctttatatttcatataatgttactagttcataaatataacaacagcacagactttcgtgagtcacgtttgagttggcagggttttttaaggatctcagcttaccaaaactttctaattaaaggtgcttgttttttatcaagttgcaaaagttggcaagaaggattttgtggtgacactaataaaagtattctgaaacaattagttggaataacagaagaaacaaaaggaaaataattgtgtagatacacagcctttcaagcttattctgccttgcagattcagacttttggtttgacttacctgtctgttctctgtagcatcaagcctttataccctcatccttactttatggttttcagcaaattgcatgtgtcttcgtcttcactagatgtcctgggaagagccaagaaaatattgaaaatgtaatgaagtacttattaggtattaaaccattttataaagctatagtaatttaaatagtgtggtaattaagagtggaattgaccaatcagtaggttccagaagcagatccaatgtgtaagaatcgaatttatggttaagatggcatttcagattagcagaaaaagaatggattattcaaataagatggtgttgtaaaaactggcttactctttgggaggcaattaaggtagattctacctcatcaaagtaaaattaagatgtaataaaaagctgaaatgttaaaaacatgaagttatacaagcattgaaagaaagtataactgcatggttgtatgctgcttgaagtggcaagatattttcaagaatgagactaatgccatgaaagaagaaattgattccattacagtatgattttataccttctgtctgtgaatattttaggtactgtcaattgtgccatctatggttatctcaatttacttcacagttttcttcttacttaggtaatttccagtatttttctgtggtaaataatgctacagtgaatatctttaatacgtgactatttggccatatttagcaccaggtgtttgttaccttttttggggtctcactctgttgcccaggctggagtgcagtggtgcaatttcagctcactgcaacctctgcctcccgggttcaggccatcctcccacctcagcctccctagtagctgggaccacaggcatgcaccacatgcctggctaattttgtatttttagtagagacggggtttcaccatgttgggcaagctggtgtcgaactcctgacctcaggtgatctgcccgcctcgggctcccactggctgagtgctgggattacaggcatgagccaccgcacctggccgtctgttaaacatcttaatgaatgtcgaaccttgtattttacagattcttgtctcattgccttaaacttccctagttgttttaaacttctgattattttttagagttctgatagacttgaatt

SEQ ID NO: 137407 - DNA, 2000 bp, Homo sapiens
tgcgtgcctgtagtcctagctactcgggagacttcggtgagaggattgcttgaacccaggaggtcaaggctgcagggagctatgatcatgcctttgcactccagcctgggcaacagagagaccccgtctccaaacagcaacaacaacaaaatccagagtagtcactcaggttccttatgagcatatactgtactgtaacacttatatgttatataattgccacgagctgttatcgatatctttagcttctatatgaaggaccctgttttaattaatttcaattttatgtttgtcataaaggatacagaagagaacataaaatatctttctttcacaatacttttagtccagttagagacttaatgttcttcttgagtcccacatgtgtatttgtctcttttccttcctgtgggaaaacctgcgcaattttgaaccactatttacgttttttacttttattgcactttatagctaactgccagattttaagctccttggggataaggttgcatgttgtagattatcaaatacatatatatatatatatatatatatatatattttttttttttttttttctttttttgagacagagtctccctctgttgcccaggctggagtgcagtggcgtgatctcggctcactgcaagctccgcctcccgggttcacaccattctcctgcctcagcctcccgagtacaaatacttatatattttttgtattgttgtgactaaacttcttgatagctttgtaaatgttgacaagtacattttgttttgttttcaaggccagttgtgcctgataccttgagctttgcccttttttgtccctttagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactattgtccagtgttcccagaggcaacttcttaatacatacttagctttgagaggtaacccactgttggaaagctttcttagaagaaaagtgttatggctggctttttaaaagcatatttaatgcttacctcaaagtaattcaagttttcaggctaattcaggtgccatgattacttataaattagttttgtataattataaatataacatgtattctgaaaattctaggaaaatgtagacaaaatgtcaatcacctataattcatccctatgagacctcccttaaagttggagcatttttttcttgcatttggaaacacatgtatacatgcatgtgacctgttttcttaagatactgtaaatatttcctcttactattaaaaaccacaaggaggtttaacattggattcccaagtccacagttaaaaggaaaaaggaactattactcaatagatgcttccaaagcactcgataaaatttatctcattaacaaaagcttcatataaacttta

SEQ ID NO: 137408 - DNA, 2538 bp, Homo sapiens
gttagtttattttgcagaagaggatgctgagattcaaagaggtagcttaccaactacctgattccaagggtcatactctttttaatagtatgctgtctctgaatatttaagctcctgtaatgggagataagtattttatgtatgtggcagacgtttgagtttcatatttgtgaggtagctattaggtctgtttttctgataagagagctgtggcttagaggttagacttgctcatgatcaaacagcttagtaaacatgaagttaaaaagtgaatccagacttgtttggttccagacctctggtccattcccaggatgctgtactgcctttatggagttaaagaacaagtgtaataatcacttctcccagctgccattcattaacggaaggcttctctctcccagcccctatccctttccctccttccactttcagaaacttgactataaatgctcaatccactccttgttacctgacaaatggacccattcatcagtagaagagagcagaaatgtatggaaataggaaccccaagaaagaatggagtcctagttttacgaagttcggaagctgtttaccatcttacaagtgaaggattttatgtaacagaaaaatatagctagtgctaatcttcacctttaattgtgaattcactaggacttttcagtctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatcacattaatgtacttactactcctctaagtgttagtgtgctgctttaaagtctctctgtactctgccacacccatcccaaaatatatattcatagcatcctttgtgtccttgaagagtaaggtaggtgcagcaatcagtgagct

SEQ ID NO: 137409 - DNA, 1775 bp, Homo sapiens
acatttgcagatggaaccaactggatagtaaatatttgggggaaaaaacaataaaaaagaacaatacaaaagtaaaaatagaaattttgaagcaatgcagtgtaacagctatttacatcgaattcagtattgtaatactagagatggtttaaagtatataggaggatgtgtataggttatatacaaataccattgccattttatacaaaggatgagcagcatagattttggtattcatgggggtcctagaatcaatccccagtggatacagagggactactctacttaaaaatttgttacgagggtagatctcacgttaagtattcttaccacacacaatcatgcacacacacgtagggacacaaggaaacttggaggtgatggatatgtttattacctggattgtggtgatggcaacgtgagtgtatacatacatccaaactcacccagttgtatgcatgaattacgtgcagtttttttgtataccatttaccccttaataagctcaggtggggtgggggagggggaagacacatgacaagctggggaaaatatttgtaacccagtgtagttaatattttcagtagctaaatcaggagaaatgaatatcccaatgacaaaatgggcatagggcatttaagaaaagaacaaacccagtaaacgtccagcaagattcaacttagcgggtaattggagaaatgcaaattaaaaaacaatttttaacctagtggattgtaaggggttgctcttggagtcatatactgatttctggctcttatttcctagttactagcaagttacttagcataaactcctagaagtggaatttttatgtcactggttatggacatttttaagacttgagttgtctattttccttgagcagcatacatgattgcccccatttcccatactgtggtcaatgctaggtactattatgaaaggcttttattgatcactttgtgtatcagtagctgtgcaaaggattttttccccagatttggtatctattgaaataaatcactgtaaaccctggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaag

SEQ ID NO: 137410 - DNA, 1391 bp, Homo sapiens
ttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctttctaaggttgaggaagtggtattgcattgtgatagtcctgttgaccccttgtgcttagttcagagagcacaagctttgaaattagacctaggtttgaatcttaccagacttttgtggctgagaggttattaacttgcctggtttccacagctgcaaaatggggctgaaaattttttccttcttgatgtgaggcaattgcttagcatagtatctggcacataagttagttcatatcgtaaatacaagccacttggttttcaa

SEQ ID NO: 137411 - DNA, 1466 bp, Homo sapiens
ggtgtgagccactgcgcctgcctggcctttgtttttttaagatggagtctcgctctgttgcccaggctggagtgcagtgagccactgcgcccatcctctgggaggcttttaaaatagatttcttgggttttctatgtggatgatcctttgacatctgcaaatagggaccatttttattttttcttttcttatctgtgtgcctgttatttctttttcttactgtattatattggctagaactttcagcagtatgttgaataaaagtcatgataacagacatctttgccttgttcctaatcttagagggaaagcatcagttatttgagttgtattgaggctggctgctacgtcttgcagcaggggcagtttaatagcctccctgcaaatgactgaagcgacaatagtgtgacagccacttgcgtaagacgtttatgagaaaaggggaggaaaaaagccttgagagtaagcgtacaaatagctcagcttatagtttccaccacatggacaggattgttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcg

SEQ ID NO: 137412 - DNA, 3463 bp, Homo sapiens
attgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagattgcttggtgccctgagttctggttctgacccaacaaaggcagtaggccatttctaggaatttgtttcaaactaacttatttttatggaaggatttttttttaaatgtaatagggttttcacctgattaacttctaagaggtagaactcattccccagttactgttcctttcattagtgaaattacagcatctcagcttctcatcttgggccctagtttcctctcttggagtaattttttcaaacaaataggattcagcagtctagaagaatctgtcacaaatttttattcttatctgccaatattttgtagtaataaaactggttttaaaaaaaggtgaggctgggtgccgtggctcacgcctgtaatcccagcactttgggaagccgaggcgggcggatcacaacgtcaggagatcgagaccatcctggctaacacagtgaaactctgtctctactaaaaatacaaaaaattagctgggtgtggtggcgggcgcctgtagtcccagctactcgggaggctgaggcaggagaatggcgtgaacccgggaggcggagcttgcagtgagccgagattgcgccactgcactccagcctgggcgacagagcaagactccatctcaaaaaaaaaaaaaaaaaagtgaatcgcatgttattaaagcatggacttggtagtcagacctggatttagatcttggtgctaacatttactgaccaagaaaggtactttttttctctcttacttcagttttctatctgtaaatagaggcaaaacttgacttgagtggtgaggactgtatgaaaaaatatcatatgaattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcccatatactgcctgcctccacacaggcatagcctcccttgttatcaacatctcccactagagtggtacacttgttacaattgattaatctacattgatacatcattatcactcaaaggccatagttaacattagggtttactcatggtgtatacttttggggtttagacacataataacatgtgtccaccattgtagtatcatacagagtagtttcactggccaaaaaatcctctgcgctccacctcttcattcttccctccccactaaccctcctcaaccactgatctttttactgtctctatagttttttcttttctagaatgtcatgtggttggaatcatacagtatgtagcctttttgtactgatttctttcacttactaatatgcatttaggtttcctccatgtttgttcatggcttgatagctcgtttctttttagtactgaataatactccattgtctggatgtaccacagtttatccattcacctaccaaaggacattgtggtttcttccaagttttgacaatagtgaatgaaggtactataaacatccatgtgcaggtttttgtgtggacataagttttcaactcctttgggtaaataccagggagtattgattgctgggtcatgtggtaagagtagttttgtaagaaattgctgaactgacttccaaagtggctgtactattttgcattcccaccagcaatgaatgaatgttccacttgctccacatcctcacaagcatttggtgttgtcagtgttctgggttttggccgtagtgatatatcatcatggttttaatttgcatttccatgatgccgtatgatgtggagtatcttttcatatgtttatttgccatctgtctgtctgtggtgaggtgtatgttaaggtctttggcccattggcccatttttaaatcagcttgttttcttactgttgagttttaagagttctttgtgtatcttgggtaacagtcctttgtatgtcttttgcaaatattttctgtcagtctggcttgtccacttattcttttgacagtgtcttttacagagcagaatattttacatttaggtctgtgatccattttgacttaatttttgtgaaacatgtaatttcggtttagattttttttttcgcatgtatgtatcgagttgttccagcaccatttgttgaaaaaactatcttttgtccattatattgactttgcttctttgtcaaagatcatcggttgacaatatttatgtgggtctacttctgggctccctaattc

SEQ ID NO: 137413 - DNA, 1070 bp, Homo sapiens
ctaacgcctgtaatctcagcactttgggaggctgaggccaggaggattgttttaactcaggacttcgagaccaccctggacaacatggcgaaaaccctgtctgtacaagaaatataaaaattagccaggcgtggtagagtgtgcctgtggtcccagctactctggaggctgaggtgagaggattgcttgagcctgggaggttgaggctgcagtgagccaagatcatgccgctgcactccagcctaggtgacagaatgagaccctgtttctttaaaaaaacaaattacaaaaggaaatctgattataaatggatccatgatttataggaaatttggaaggattagaaaagcatgaagcataaataaaactatgtgttaccctgccagctagaggcaaccattaaaggccaactactaataatgtgtatttcttcccttcccaggtttttttttttttttaactttcccaccctgtggcagacattttctcataaatagggaagtgataggtacagagtacaatgtaatcacatatggtgggatatccagtcaagatttgaggggttcgggagaagattgtccaaattctggatatcattctgttcaaacctgcataagtgcttattatattacagtgaaatagaggctaaatggtcccctacccccaattttcaaagggattcttacagttactccgtcttttcaagacagtttgcagccacttgagaacataagctagtgtctttatttaccttttcctctacatttcagtgaccccataattctctgcttccatttacagcctatatatatattttttcccccgagatggagtttcactcttgttgcccagactggagtgcaatggtgcaatctcggctcactgcaacctccgcctcccgggtttaagcgattctcctgcctcagcctccgaagtagctgggattacagacatgcgccaccacacccggctaatttttttgtatttagtagagacggggtttcaccatgttggtcaggctggtctcaaactcctgaccttgggtgatccacccgcctcggcctcccaga

SEQ ID NO: 137414 - DNA, 2391 bp, Homo sapiens
tctgtacacctggctatctgagtattcatctcaatgccctgcatatagtatgtttataattgttgaatggaaagatgaaggttaaatgaatctaaattgtttttttcagttcaccaagagtttaatgtgacttggattttttttagttttgttaagcatttactggatagttattcatttattaatctgctattaataaatgacagttcatatgctggtacaggaatgcaaagataaatatgatacagtcccactcttgcagaactcagcaagcatagtggggagactgtcaggtaagtaaagaggtgtgctgattgaggatcaatatgcaggatatagttggggctaaataaagcatgtggggagctgagggaaatattatgtaatatcatagcactggtaagagaggtaagcagggaccaggtcctagaggtcttggatgctggtttaaataaggagtttgtacttgatgtaggtaggttttgagttttagggagattgctctggcaacaatgtggaggatagaatggatggatccagcaggaaaaagtctcactttaaaataacttcaatttatgagacttttcaaaacatatacaaaaatagaaaaaagcataatgaacacccatgtaactgtcacccagcttgaacagtgatcaacacagggctattgttctatttataccccgctcctcccctctatttttattaaagcaagttcctaagtcacagaatggcaaagcatatattgaataataatctaatgccatggctctcaaggctggcctgtgctgccaaatcacctgtacagcttgaaaaaaataatccccacttcagacctactgaattagatagctttgaaatgcctgtgtggtcaggcatttttagttttcaaaataagtctcgggtgaagtaagttatttttaagataattttaaaataacttctgacaaatgaaaatactttcctgaactcattgaatgctgcctgtggcccttctgggtgaaattcacctattcgatacaggcaggcttttcttataaatttttatttattttttgtagagacggaggtctcactctgtggcccaggctggtctcgggaaaactcctggcctcaagtgatcctcccacctcaggcttatcctcccacctcaggcttccaaagtgctgggattacaggcatgcagccagaaactgacaattcttaaggtgtagactaggaatattccagagtaccaatttaaaatgtgtagacaaggagtctgttcctctcctgcttaatttgcttaacttacacttaggcattgctgtttttattttttgttgagaataccaagaagggctccttagcatgctgtcatttcctctgtattggtaaaattgataatctgcaactttggtgagccatgtttggttgcctagttcttctgatgccagtttctctaagtaattgggagtatccgggaaggataactcccagatctgcagcttccccagactgtttgaatagaggatgtggcaggagatgtgttctcagatactattctcacgttcaaagtcaacattggaggtttcagattcctctttcttagtatccctccctgcccatattttccttgcttaagcataactgcagtgcagagaaacacccagagccagcataaactcttaatctgaggtatagtgtgttttcagattttaaatgagagactccttcaaggtatttctgcaaataatttccagatttgtcttgggtgagtaaaggctatttttcagttgctttattatgacactttactgtcagtgcccagtaaaacctaggtcagcagttctcagggcacttgagagtcatgttttatgtggctaaggatagggagactggtgtctgtaggagaggggcgtagcaaggtgggctgtgcatatagacattatgtgcaatgtagagttgtggaacagatttgggtttgaatccacgttttaccacttaataggtatgtggccactctcagtaaactgggcacagtcttcatctccaaggattaaagataatgcacaataggtatagagtaagtgttagctatttttttatgatcataaatgtttttcacaatatttgttgagtggatattaatgtattaatagataatcagaaactagataggatggaaaggcctgacaattatgtggtgtcccctttaacaaatcataatcagtgacacctattcctctataatcaaatagtgaatagcaggctggatttcaagatgcatcttactgcttgttgacatgaagaatgctcagggcagctctcacctgaatttactttcagagactataaggcaaaaggaaatcgttgcaaggcaaaaaataaagtattttgctttgtggt

SEQ ID NO: 137415 - DNA, 1318 bp, Homo sapiens
ccttgcatttttcactgtgatatgtttagtatatgatccatcatgatttacaatattgtagcacatcaggataagccttgataaatcagaagagtataaatctggatatagccagtatcgttgtagatggctcactgcatatatacacgtatatacatatacgtacgtacacgtatatacatagacatatacatatctgctgccatatttttccaggggctagtttgactcttctactttggagggctttgcagtttgttaacccaatctggagtccaggccccggcttcttacatttctttaaatatcttggtgagaccagccttaaaaggaagtatagtctggagagatgcagacatcactagaagatatccttttacgtagagaattttagatttttgcttttaaaaagtaaagacaggctgcttttatgggtgaattcagatctctccctctagcaaattaccaacagctttaaaagggtagtcttcatgtccaacagaaaagctggatgataccctatatttcctattatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggcaaaaatccaaagaaagctcagtttctttgcccttttaaccgtagttactactttctgacatgagatcaacttggagctctttcatggaacagttcgatttggccatgtgttttcatgcatttatggatgctataaatcagtagatgagactgaatttcctgcttgtaaaactttttcaaattaaagggctgctttctaagtccatcttattttcccttccttttttcaactgttttaaactataacatgtttgctatttttaaaaagattgaaacaaaataatagtttacaccttttagcattatagttaagtattactgtgttaagtatatacttatgttaagtatttttatactatgttaagctttttatgctgaagtaatggtgtgaagtaggtgtgtacttttattttcatccaaatggttagccagtagctcctgtttttcttcctggcaaagtctatttgatctttaaaaatattcttagcttaaaagtgaattatttgcag

SEQ ID NO: 137416 - DNA, 2238 bp, Homo sapiens
gagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagaggtgggcagtcagggtggtgaaaataatggccatttaacaaaatgtgtctggaccctttaggtctgtgtgggatcatcagtggtgaggcaggatagggtttgttcttgagttattttgggtctgagactttggccagtgataactgaatgttccatagagtagtttttcactttggaactccttaggagtcacatttataccctctgaagggtcttagctagttctgtaatgtgtattacattggttaccttgatctctctccgtctatactggcccctcctattcaaggtgttcaaggttctgttgtaaccttagtaacctataataagtattcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaagggtcagtatggtaatatgaggaatgaacaaaatgtgctatagcagtttacaagaaggcatcagagaatgtcacagagttttgttagggttaagcaagataaatgaaaagtacttcatgaattcaaaaatgctatacaaataagttagttaaacgtaccccaaatgaatcaatagtctcaaaccattattgtttcatttcttcacaagacttactctttagatgcatttatttctttgagctagattttatgacctccttaagggtaacctgtagtagagtatcctgaaagttaatgcttttgtctaaaaggatttttttcatccattttatcattttctagtttttaatcactgaattcaggaaaaactagaaaatgtgtgcatatttggggagaggatatacataattccaccacaatgtttagtcactgttaacattttggtgtattcacatcttaatgataagggtagtgtttaaggaataagaaaagaaatctagtaggaaattttaaggataggcatttccca

SEQ ID NO: 137417 - DNA, 7798 bp, Homo sapiens
aagcgtgagaataaacaggttgactttttaaattttcctcaagcactaggctctagacacctagatcgggggcggaggcagttttcaggacatggccgagatttggcgctgagctgtgtcatcgcgaggtttggcagccagctccgcagtgggtcggaaacctcgtggtaggcgagatccctgcaggacgggagggttcctcccttcccccgaaaaactcccagtcattttcatgaagctccgcctttctcctttttaggagtgtgcaccaggtctcgcgatatctcatgtttcctaaaggcgaggcgcgggcggcatcctgcggtgaattaagaaggtctcgccgaggctaaagcgtaatatcgcgatagttctcaacgcatgcgggagccggccgtggtaggttggctccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagctcgcgggtggggggtgggggggcagtgactagggtcggtccgcctgctgttaagatggcggcggaggctgatgtctgtccggccaggacccagcacagaggtgttggctatctgcctttatgacgcctctgaggtgcccagcgttaaggaggtgacgattggcgaaacgccggggtgccggtaaactagacctgaggcgaagaccacctcgtttcttgtccgttgaggcgacaccatttcctgggcctcggccgcgtgtgggcccgcctttgccccaccgatcggtcaacgcctccgttgtcgccgccgcagtgggcggattgggaagggtgggaggggagtctggagttcgctggggagtggggttgggggttaaattgaacggtgggaaagaggagcaaccaatgaagagtggcccctttcccctaccttttctgccggccaacctccgttctcagcacctccgacgacccggatgaataccctggtttttctcgaggtggggtcatcttcgccaactctcgcggttttagagctaaggcttagggttcaagcagtagtgtcactggtgtactcctcctcctctccccacacccctcctaattctgtcgtcccatctaatcttcatctacgtggatagttgaggctggtatttaagggaggggggagtcaaagcttttccctgtgactccttccccagttctaaattcgagtttagcctaagtcctctagcccgctctgtctcccccttccattggtccccttggcgcaggcgttgaatagagcttatcctgttgcctgcatttactccatctttgtggatggtgccatagtagccttccatttccttaagtcttcatgtttgtatgactctgatccggatttcttagctctgcatgctgctaaaccactattaagcgaaactatgaacgggtcggtgtttggatattgcagtttaagtggccttttcgtttacggccattagccttgccttcctcattcctccccctcagaaggctgtagaggataactctccagtaaacccgctttctgtcttccctgcctcttccatttcccctgcaagcctgggaaccgccccttttccctgccttgctctgagtttctggagcctcttggtctgtggacatctatttttgctgctgagcacctcttacctgcttctcacttcttaatctttctatcccccactccccatactccttttccaggagctgaatcccttagaaggaagataaccctcctctcaggctccactacattttaccccttccatttactagaaaacagcattgattgtcctgccccccagtctgccctgttctttatttcctcttccccccatgccaccgttactataggcagttaattccctatcatttgtttctcctttgtagattacatgttcagcattgttttcttttagccccagtgttgcatagattgaggagataccaacattccccagtcataggcggcggtctggtatggtgaaattaatagtgtgtgttttgggtgtgttttgggttcacattgaaccttgtgaccttgggcaaattttcagattctcagttcatctatataatgggaatagttgtgcttacattagaggattgttgctagaattagttaaaataaaataaaataaaatgtttagctcatggtaggcacataataaattaggattactttttggtgtaagaatgcattggtagatgtacctgtgtcatatgctaattttatgacctgggaaagagtaagagatttttgtttctttaactgtacattcttggtgtatttctaggccagatctataacgtttatattttttttcctcataggccaaactttttatctccagtggttcatgatgtttgaacgtgattcccactctttgtttccttctaatggtctaggaatttcagtgcgtaatcactatcctggaatgaccaccagccataatgttcctgtcaagaaccacacccaagtgttctaccttttggaaggggtgcctcatgccctgcctactcatttcttccactccttcaaaggcagtctgtcctgtcattcactctacaaaagtaatttggtgtcatgcatttcacagtggtaaaaggaacttctgttagctagttttgaagtattcatgctacttttcacctccctcatttgtttggttcctcagatcagtgtggggatctgctatttggcatcttcttacctgagcaagataattcctgtccgagagagaaagatcatttggaatacccagcttcttttccatagcaaattactgctggctctttaatacactacttcctgttgtgttattgccattttatattttctaacgtacttattaaacagatgtgactatttgacttggagaaagttttccttacttttttttttttttttttaagatggagtcttgctctcgccaggctggagtgcagtggcgcgatctcggctcactgcaacctccgcctcctgggttcaagcgatttacctgcctcagcctcccgagtagctgggactacaggcgcgcgccaccatgcccagctaatttttgtatttttagtaaagacggagtttcaccacgttggccaggatggtctcgatctcctgacctcgtgatccgcccgcctcggcctcccaaagtgctgagattacaggcttccttactgttaatatattgattagaccaatattaaagtgtagcattttacaattttttttttaactaattctagcaacaaccctttaatacaagcacaactatccccattattttacttcggctgggtgatgggaattgaagtagaaacgtggtgaaaagtttactaggatttaaaatttacaggaggtaaccatcccacaattagctgtatgtggactctagtttcgaacttcagggtctgctttatttaatttgaagtgctttgtaggtaataaaattttcttccattttcattggagggcaggaaatcactttctgttttgagattttgcattggtgcattttaccgtgggttaagcagtgatcacaaatttattaaacctcaatttcaatttgacccttattgagcaatagaataaatctgggaatgataatctaggtgtgacctaaaagtttaacttattctaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaaagtgttgggattacaggcgtgagccaccaggcccagcctgtttcatctatacttctaaccactgcccccctcaatggattatattggaataaatccctgtcatatttatttgtaaaatacttgtttgtatttctaaaaggcaagggctctttaaatataagatcaaaactattatcacaactgaaaaaattaacagatatttaaaaatatcaaatataaaatgttcagatttctgatttttttttaagctttgttttttttcttttacagtttgtttgaatcaggatcctgagaaagcacatttattgcaaagcattgatacagctgttaaatctattttaatctgcaggttctgtcttttgttttttttttcttccaatttatttgttgaagaaattgtcctatatatagtttcccgccccccatatttggggattacagcccagtagtggtgtctaacccattcttgctcaattaaagaccctggaggacccattataatggaacaatggctataatctcctgtatcctagttggagttgatagtgctgtcataggcactatcctaaaataactagtcatggattcctttttctgtggcaaagtctgatttgatacctgacttcagttccatgtcttggccttgctcattgctccacatgaaaagtaggcctcctggtggaagaagctagtgtttcctaatgacctgattgtgcctttggggtttttcatgcatggtttcaatttccttaggtgatttagttatttttatactactttataatgttgctttttattcttttgatgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatgattttggaagattactttgggtacattatttgctatgattattttcttatattcctgtctattttatagtgaggcatgtttctcctggtctttgctttttttttttttttttttaaacttccaatattctttattacggcattctgacaattgagttcttacaggtggaaagacctttcagcacagcgattaagaacatggactctggagctagattcacagagttcaagttctgactcccatttcttaccaggtgtgtcatgttgtgcaaattacttaactgctttgtgccacacggtccttcatctgtaaaatgatgataatactgcctgccttatagagttctgaagaaatttagctgagttaatgcatataaagtgcttagaacaatggttctgaaactttagggaacatcagaatcacctagaggacttcctaaaagattggctggtccccactcccagagtttctgattctgtagatctaggaggggccccagattttgcatttctgataagttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatt

SEQ ID NO: 137418 - DNA, 1111 bp, Homo sapiens
gcgagagtgcctatttttccacagttatgccaacacgtattatcaatctttgtaattttagccaatttaaagggcaaaaaaatcgtatgtcattgttttcatttgcatttccctgattactggcgaaattgatcatatttttgtttgtaaataggcaaatatcaatagtttatataggcagttttcctatctataagcaataagcattttgaaattttaataataaaaaacctgttcgcaatagcaagagaaacgaataaaaatacctagaagtaaactataaaactttattgacgaataccataaaagaacatctgcatgaaaagagaaggaatactatgcttctgaataagaaggctcaatattttagtgatgtccatttttcctatattggtttatacagttgatgcaatttcaataaatataccaagtttttttggaacttactatgattctaaagttcatccgggggaaaaaaatggctaagaataactgaaaaaaaatattttaaaacgtaagtaaagatagggatatttgtactactggctattaaaatgtactctaaaggaactatttaaattagaacggacagaacaatgcattagaatggaaaagcccacaaatcaagccagattggatcccaagatttattggagaaacactgttggctagacgtggaaaaactgccatattaaaagcttcaggcatttccccccatccccgaagcttgaatattcctttgagggcagactcctttgtttggagaaaaccactttattggatctttttggttatgccaaggtaaagcttcagtagttaaaattggtggctttggaactagaactaatgatatggcctttagttagattaagatggattcaggttagcctgcagtgcggcgagggaaggagtctggataatgtaggtttaaaaatttttttccctatctaatgggcaaaaaatgttatgtcattgttttcatttgcatttgtgtgcttactgtgagattgaacgtcttttaaatgttagtccaggataatatgttattcctggagacaggtaacaatgggggactctttgctccgcttccagaatggagtttggctaattg

SEQ ID NO: 137419 - DNA, 1072 bp, Homo sapiens
agaaagggtgcaataattcaaaggggcctaacaagttcaatgggagggctttccagagactgctttttcaagtgtgtcctctttctgtgaatgtgggattttttttttctttccctctctcttccatgcacttgttgtgcaatctggacttgattactgtgcttagggccagtacatgggttagaagaatataattatcagagcttgttttcacgattatcgcacttgttttcttgtgccaggcactgctcttaatactttattgattcatttcatcctcaccaacaccctcatcctgccagcgaagaaacaaagtaaccttcctgtatcatacatgaaaattctgggaccaacctggttccagaatgtgtattcttaccactctgttctaccacttctcactgataaacactaccattatattaagtgccttttgggtgccaggcattgggctagggattttacttagggatatctcatttaatcctcactgaaaaaccccatgaggatattcgtcctatttaacagtttaaggagactgaagtttgccagtggtctgcagcaggatctgcctgattccaaaacttatgttctttgccttcaccatattagaaaatcttctgaggctcaagcacccaacagatctttattaagcctctgttatgtgcaagatgcagaattgagagttatctcctaaggagagctcccagggtgatcttgggagcctcagtttcaaattcaccaccaccctgactctgtgggtgagccagggcaggctgcttactgtctgtgggtcatctattaaagtattttgaacccagtcaagatttacttcctcctggagattctgcttctgtgggtctggagtgaggctgtctggttttggcacctactggttaaatgacctcctccagttctcacagtctgtctcaggagtaggtggggttttgataatgttcatgtctgaagcatagagaactgtatttcctggtagaaaggaaacaggaaagaagggctttaaagcctttgcaggaatgatgggctgggttatttttgtcaccaattcccaccc

SEQ ID NO: 137420 - DNA, 1046 bp, Homo sapiens
ggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttg

SEQ ID NO: 137421 - DNA, 1025 bp, Homo sapiens
tgccagagggaatggagaggaaggagatgaactgatcaaatatggaggcagtcaaataggacatgggaggggatttaatgtggggagacagagacaacaaagagttagaggactgaagccttcctttccctcactttggtcctcaaagcccagtccctagagtacgcagctcaagggcatggaggttggtgtgatgttgaaggctgatgaagatgagagtttctaatgaagcaaggccctagggatggcaacttcagggacactgagctctaatcactaaccaggcacttgtccagtcctggtgggtaggataagagggtatggaagtacatttacctccctgcaggatcttggaaggaaaatgattgggaccagagtaatcagtggagaaaaagaactagacaaactgtaatcagggagtcttgctgctacaggaggtcataggaggaagagtcaaagcatgtggtgttggttggaagtagttaaggagggcttcctgcccaatatggtctaaggatggagaaactttgtgggtagagaaacaggaaggggaggtggcctgagggcagttggtgccagatttgatgttgaagcccttgccaaagcccttgcttacttttcccttcccccacaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttc

SEQ ID NO: 137422 - DNA, 1837 bp, Homo sapiens
gatctagatatgaagaggtaattctggatttaagtgagagaaaaagggacagaaatgcagttcctggtatggttagaatagcagtttggctgagggaagagattctgaagccaaatggcttggatgtgaatcccagtttgaccacttactggtcctgtaaccttagggaaatgacttagcctctctgtgccacagtttcttcatccttcaaatgggattataattcttacttcttgggtatttacaagtattaaatgagtaattatagaagagtggttgacatgtattactaatattgttattattgtaccccagaaatgcccgtggtagccacagcctgtgagatcttccgaaggcaggattaggcttgtgttgccaagagaaggcaaaaaaatgtgatcactgagttggtttgtgtggctgtgtagcatttcagaaggtgaagtgatttacatgctctcagcaccacctttccaggttctcagggctccagatgcccactatacaagtgtccaccatgcagtggatagtagatccatagggcagtggatggttgaaatacaaggtattgggagaagtgacacaactccttatttgtcattcccatccccaaagtgaggtttttagacccagtgacctggaggattgtcaagcccactgttaaaagaaaaagaccagcaagaggaagtgaagccattataagagatgaagatagaataataattaaccacttgtcgaatatctactatgtgctgtgtatttttatgtcatcacttaatcttttcaaaaatcctaaaaagcagatattattttacctgttttatagatgaggtagctgagattcagaaaggttagtcagtttgaccatagtcatccaatttagggacacaagcctggatttgaaccagatttatctcattccaaaactaataatctttctaatctttctacgctcagattttccactttgagaagtttgcaaggtgtctcttcagatagacctggttagatagtggtcccaactacttttcagctgtgaggctttgggctcaagttacttaatatccctgcacttccattttctcatatgtaaaattaggattttttcttcttagagctgttatgaggattaaatgagataaagtatataaagtgtctcagctgctgatgtaaatttagttattatcattagacgtgtccaaggtctacctcattagtggcaacactaggaccaaaatcctagtctccaaattcatttacagctttcttggcactgtactaataagtgacagtggtgacttaaggatggatggtaacaaagagatgatctcaggtattggaaggcctgttatgtgctgtgtgtacatccaggctagacttggtgcaggtaagggagagggtggcaggttgcacaaccatattggacattgtctagttagttcctttcctgggaacttgtcttcttcactccttaatctctcctcctacttggcttgtgtttcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcagga

SEQ ID NO: 137423 - DNA, 1112 bp, Homo sapiens
gcccaggctggagtgcagtggtacaatcgtagctcactgtaacctcaaactcctgggctcaagcaatcctcccacttcagcctcccaagtagctaggactacaggcacatgccaccacacctggctaactttttaattttttgtagtgacagggtcccacctcaccctcccagagcaatgggattacaggcatgaaccatcatgcccagccaaaggaggttcacattttttttctttttccctctgggaggtttacctttatcctttaatcagtgtgtgctttgagcattggtgaattaggttcttatgtgatggcaagcaaaatctggcttcataaaaagctagaagcaggaagaccaatgagagtacctttggagagcttggaggtagggaatatggctagccttcggataaatgtcttagtgacaccttctcatcctgtttcccttgcagcccgcgtgaccccaactctgccgaagcaggaccgtcctgtgcgtgaggggacccgggtagcctctattgagacaggtttggctgcagcagctgcaaagctggcccagcaggtaggtgctgacaccccaggtcaccctgcaactaatagcagtttgacttagagcctcaacacttagacctgcaggctgataggatcccacctttgtctcaatggggattgagtaacctttgatctttatccttggcagtatcccagccccctcttaaatccctcttatcccaactcaatgataagctacttccacaggttacacagttgacatgattcaggatgaaagaaaatattaggccagagaaaaacccacttaccttttttggtgtgtaaaaacctctcagatgagaaggaccagatccttcctttgctctcatatgaagccctgagggggtgactcagctgagtacgctcaagttctcagccacccaccagtattggaatttggttgattagaaatttttcttgtcctctttatgaaataatattatcttaatcttcacccacaaattttttttttgtcctaaagagtgatcttcactagaatcaaattcatctcctagcattacatctaaaagttctttaatgtgcgtaatgtgcttaggag

SEQ ID NO: 137424 - DNA, 1010 bp, Homo sapiens
aataccatataacagcttcagtagagggatgcacaggaagctatggagagccaagtaggaggcatctcaatcatgattaggagagggagggaagagttcttgtggaaagtaaatctaaagctgaattttgaagggtgagtaagtaaagtaactcatgaagttattcactaaatggatgttgggtgaatgaatcagaattaggtgaatctaggagaaggacatttgctgcaaggatgcaaagtagaagggcatgaaatgtatgtggtacattcagagactcttggagttgagtatggattaagtaaaaggtacatttgtaggggaagggcaggagctggagtaggtgtcattctatcttcaccctttggatgaaatctcattttaccctgttttcccttctccctgcagtctatccttcactggagtctgatgatgatgaccctgctttgaaatctcgacccaagaaaaagaagaattcagatgatgctccatggagtcctaaaggtaatctagtattttgtcccttaaactctgtaggggtggtcaggaggaaatagacaaggtaggtgggatatttaatatcagaagacctgattcagtcactcatttgtttattcagcaaacatttgttgagtgtctgctgtgtgtcaggcactgtgttaggttctggagctaaaatgactaataagacacagagtttatgtaattagtccaataaaatcagaggtaatggagcatattgcatttgatattatatggtttgaggtgaaaggaagaccttgaacagattttagcaagcagtctgaggcttctgagaacgttctgataccatcatcccagtactctggtagttttgttgtcaaggagggaaattctgctgactgttgagctctataaggcccaagattatcacctatactgagaggccatctctgaggagggaagaatgaccactgagttgaacatggagtttagaggataatggaagaattttcttcgtctccttggct

SEQ ID NO: 137425 - DNA, 1007 bp, Homo sapiens
tttgttttttttgagacagaatctccctcattaacccagggtggagtgcagtggtgccatctcagctcactgccacctccgcctcctgggttcaagcaattctcgtgcctcagcctcccgagtagttgggattacaggcgtgtactatcacgcctggctaatttttgtatttttactagagacaaggttttgtcatgttggctagggtgatctcgaattcctggcctcaagtgatctgcccgcctgccttggcgtcccaaagtgctgggattataggcgtgagccatcgcgcccggccattgttttaatatttcaaaagttatacaaatatggttaatgcttattgaccaaaattagaagaagatggagaaagcaaaaattctttttgactaacactgtttcctctctgaacccaaagataacctttgtcatcattttcatgtataccttttattttgttgtgtttacattcatatgtagacagaagtgtagttttagtgtgtgtggttctgcaacttgcttagttttctttcaatgtcagtgcagagatataccttatcaatacagagatctatctgctgcatagtgttctgtaatatagaaatatatcatatgtttaatcattccctactgattgacatttaagttgttcctaagtttttacttttactaacaatgctgcaatgaaaattcttacagtaaccttttgtacctgtgtgccagttaatatttttctaggggggatagacctgttgagttgaagggtatgtagaagacaaatgttaataaatagtgccaaatttccctccaaaagggccagtacatgatcagtgtatgaaacatacctgtttacccatagtcttaccagcaatggatactatcagcctttttaatttttgccaaccttatggcaaaagatggtgtcttgtttgttttacgtgtttattgactcttctttattccttttctgtgaattttccattcagtctttcacccatttttctgtt

SEQ ID NO: 137426 - DNA, 1041 bp, Homo sapiens
aggacccagaagagctttttattatgtggtttatatttatcaatttttaccatataaattaaaatagaaaatttaaaagtacttgttaacttattaaaaaataattataagcccattacatgttagcataaataaaattttttttatgaaaactgttttcaaaaatgtttagtgggaagaatgacattgttttacatctttgcaaatctctataatatctaggttaatcaaaaattgttagaaccccagatctgcttttgctttcattctgttggatgtcacatcatgtacttcctggaaaactccactgtatacccatgagaataagggtgaaaaaggcaaagaacatcataatattctcatgaatatagttctgagtggcatctcagcttctctcaaagagtctcagggagcctaaggattccttggaccacaccttgagaacatctggtgttgggaagccagtttggaggctaactgctcttaaggagttgggtttgagatgagtaggtagtggagataatcagaggaagaaaggccctcttccagctttgattttgccttgttacactgcagggtggatccatgctgtgctgacgcctgtggactgccttgcctttggagggaacttcttacacagccttaacatcgagatgcagctcaagtgagtactgaaactgtggtgattctatgttggccattcctgtctgctagagtgaggagtataatgtagaaggaggggacatggccagaaaggaatggttcctcgttcctgatcatgttcagctgaagattaacaccttttctgcacttagtagttatttgactttgggcaagttatataacctttgaacccaagtttcctaatgtgtaaagtcagatcttgcagagtcattttgaggattagagatacaaagcatccagaacaaaacctgattcatagtaggtgctcagtaaatgaatccttgtttttgttgttggtgtttcctccttctagagcctatgagattgagaagcggctgagcacagcagacctcttca

SEQ ID NO: 137427 - DNA, 1022 bp, Homo sapiens
tgtcacactatgttgcccaggctgatctccaactactgggctcaagcgatctttctgcctcggcctcccaactgggattacaggcgtgagccaccacgcccagccccttctccttttaatagtccataaaaccccaggttgagctccgttttttacctgggaagttctagggatcattgtctgtcttctgttgaaatgagaaagcttttgactgttgttctcacatgccacttgttgtctgggcatgagtttctggggagaggaagagaagaaatggagaagcaaggcccaggcagatggactactatgtgtgaggctgtgtgtctggtagttccattgccctagcagggcacatagatctaaggaaagtgcgatgggttccttcccctgccccccaaacaaacacacacatatatgtacagtgtcagtggagagaagctttgagtgtaaggccattctagggactgatgaggggacaagagagtcttccacagtccctgagactacttggtgcagaacctatctctttactccaggttctgacaaagagattgatgtgattgatgtgacccgccaggctgactgcaagatgaagcttggtgattttgtgaaatactattacagcgggaagagggagaaagtcctcaatgtcattagtttggaattctctgataccaggtaagaggtgcaggaataacaaaaaaacctgacaaagtgcctgaaacttgtgtgatatatctagtgtatattcgtgtttctctctctttttttttttttttgagacagagtcttgctctgtcgcccaggctggagtacagtggcacgatcttggctcactgcaacctccgcctcttgggttcaagcaattctcctgcctcagcctcctgagtagctaggattacaggcgcccgccaccatgcctggctaatttttgtatgtttagtagagatggggtttcaccatgttggccaggctggtctcgaactccctacctcaggtgatctgcccgccttggcctccca

SEQ ID NO: 137428 - DNA, 1024 bp, Homo sapiens
tttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagt

SEQ ID NO: 137429 - DNA, 1048 bp, Homo sapiens
gatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatgg

SEQ ID NO: 137430 - DNA, 1326 bp, Homo sapiens
tatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagt

SEQ ID NO: 137431 - DNA, 2231 bp, Homo sapiens
ttctggagccacagagggatgaatcctttggagctctaaaagcaaccagtatcactgagctgtgagatacctatatctccattttctaataggaagcacttggacttaaaattgctaagatattttttgcagttgctatttctgtgcatcttgaatctatctgacacaatcaaatgacagtattgttaactctcacaccattaagaaaatttcttattttgtaggcattcactgtgagaggtaaaattgctgctttggcaggtatgattccagtttgccaaacggcttttcttccttccacaacctctttttcccctagcccagggtgaaacaagtgggtcatctccaaccttgatttttatttggattcagcattttgggtttggaaggttacaagaaggaaccataaatggccatattcctagatttttatttatctgacaaaatacacaacttaaaagccaggaaaactaaggttcattacagggagatgaactttttctaattggaggacaaattgtggaaggtggggtctgatctttgcttcaccacttgaagagactgtcatccttcacctgaggttccatttctagcttttatgtgacctctcttgaacaaagtcatttgggaacccccagaaatgacccctttacattgtaggaccataagcaaaacactggttgtgtatagtcactgatccccaaggacttgcagttttttatttctgctggtgtgtcttgggatcagcttataactcctactcttacttagtcagtgaccagtccagtctggtctggaccaggcctgacaaacttctgctcacttgcatcattttcattctgagccagtaggactttgggtagactttaaagcccaagaattggtactcgctttggctagtgacatttgatttttgtctccatcttgatttctgacatcattggccaagtcacattaactttttttgatcactgagaaaaacagtcgaacaaggcattacagagggtggttaaggtagagggtggggggcaggaatgcttatgtaggatagaaagaatgtgggggtagctgtttggttatggtgatccagtcctttggaaccttacaaggctcctgtgggcatgtcaatgttaccattacagcctctacgacccacccacctttgaaaagtcagtacaagtagaccacagtttaaagtagttagtataattctactaaggtttaatcattatacttgttcacttcctggtgcatatttcctaaatatgcttggggtgtggggtggggggttgagttttcactgttccattgcgtgtcatcttatatttttctccatcctgtgactttggcatcttactcgactttctattttcttttcccttggcttattgcagtagtctgctggtgcaggtagagagctcagtgcacctattcccctgttactgctaattatcttgaatattgtcagaggttattttgatgttctaagaatataaagtcattttttacaaaatcatcttttccaagttaaaagcaaaataaaaaaatcccctgtgctagggtgcccatttcagcttttgacattgcccctgtacttttatagatgctctttttgtccgtgttggtagtaactaatgactagtgaattttcatgtaaatgaagcaaaataaatatttcagattttattaatctctcataacccagccaaatctgatgacttcattttaattgcttcccagaaagcacttcccctcctaccttctattctattctattctattctattctattctattctattctattctattctattctgttctattctgttctattctgtttttagaataacacactaggtaaagaaactttaactgcaaggagtcagtgacttttagtgctccctgataaatgatgttattgacaaaagtaaaaaattatttcattgtttttttcctgtattactatctcctctcctgtgcttttgacagtgtgtttagtggatggataatatgtatttctctttcccactcccagattccaaattccctgcctttttggcccacctcaccacaaaagctccatagtttattaatgtaagtttgaatggatgcttctttggggaaacttcaggagttaatggaagagtttcagaaaggaatgagaatgcctcaggagttgttctgtgatggaaattggtctgttgttctgttaatgctgatggaaagaa

SEQ ID NO: 137432 - DNA, 1057 bp, Homo sapiens
ggtttgtgagaccccttgggtccagaacaggcatcttaagtaggaatatctttatcaatctcccttttctgtttgacactgtctttctacattttttagtcatatcacagaagcatttcatcaccagcctgagtggggaaatcccaatcgtgacagagggtcctgggcacagcctgttgatactggagtttcagaagcgagcctaggtgatggtgagccccacatcccatctctgctgtctatgtctacaaggaaccacatggatatcaccattccacccttacctccagtagctccagaagtcttgagagttgctgaacacagacaccggaggggtcttatgtacccatatatctaccatgtcctcactaaggtgaggcagcacatcagcacctacctccctgctcttaacactgtacttcctacttcctaggactgtaagttacagagaacattctggtcactggtatatgaagttagaaaaagaaggccacatgtggtgggcccctcatcctactaaggccttaggtgaggccagactagcaggagttgggactgtgtggtaaatgagtcccctagaagagaagtgtaattgtgagattttgaagtagataatgcaccaagttggtctggttctagggatggacacagtctaagaggctttatgcccttttccttatttctttttctacttccacaaagctgttcccctcctctggtcttatacatgtccatcctcgagcaaaatgcctaaggtggactttccccattcattagctatagtcattgttgagactttattttattttattttgttttattttttgagacagagtctcgctctgttgcccaagctggagtgctgtactcttctgcctccgaggttcaagcaattctccggcctcagccctcctgagtagctgggactacaggcacctgccaccacacctggctaacttttgtatttttagtagaaacggggtttcacctggtctagaactcctgacctcaggtgatccacccgcctcagcctctcaaagtgctgggattacaggca

SEQ ID NO: 137433 - DNA, 1164 bp, Homo sapiens
tgactgaagtatagctctttctcttggcttcaggttttcggaataataggcttggaaatcctccccttccacgaaatcaagtgggcaccatttctgctggaaagccaatggtaagcatcctttaagaagcctgagatagcattagactcaggttgcttcctgatttttataatctgaggagttagggtgattcagtgttattagactgtcagggctatatatactatattaccttctcaacttaaggctggaagactatgcaaaaaaagcatccaaatcagtaaccactagtcattgtgaaaatagattagctaatatcagagaatagttctaggagacttcaactgttcattgtcctgtctgtggaggattctgttcatacatcatttctcattattctcattaggtgctttgtatctcaacaatctccactgctggcatcatccactgtgtcacaacttctgagggagccaccttggagccttataaaatgttaaatagcttttctgtctgttttatcgtttagttttctcatcaagtgccccagaaagtgaaatatccaccaccattcccagtgggacccaactcatctcttctcttctcctcccatgctttgggggaatcccatgctttttctgaggatcccatgctgcagaacagcccctttgccaattgggctgtctcctatgactcttctgcatcccagtttcccaattacctgccttctaaagcctcacctcctttgggaccagactcttcccactcctcttcctctgatggtgatgagccaaatggagctagctctgagtaagtatctctgtagacacctaaggaagtagatttctgaggcatctgtattattttgcttgttagatgggtggagggtgtgggaaagtgtattcctgggtttcctctgtagtgttttgctcttaggaaagcaaagtaggaaaacgttttctatgcttgcccacttcatgcttatttggccctgtgcagatggtaattttcaaacacccaggccactgaagtaaaaggcagcataggagctgattaaggaagccttggtatgggtattgtggctgtcatttcttaatttgtgaggagggcagattaaatgtcaaaaaaagaaaagcatttatagagtggaaatagtggaatcgttga

SEQ ID NO: 137434 - DNA, 1031 bp, Homo sapiens
atagcaaaaaagccaaaatgtctcatgaaaggaagcctgattaattgtgacagtgtcatatacagtagttatctctgcaggaagatggatgatatgtttttattgctttatacttttccatcttttccaagtgttctgtactgagaatgaaggggcaaaactatttttaaagaaaatattttaactgtctctctgtggatttaccaaatgtgaattccatatctcccctcaacttcactctttttcttagtgatccatctttgatgtcagtgtcccttgcttatcttgcctttctaggttcgagctcatcagctggttcttcctccctgtgacgtggtgatcaaggctgtttctgagtatgtcagttccatcaaagatccctcaaacctggatgtagttgggaaggatgttttcaaacagtctcaggtaagttagcattccccttcctaagagtcctccgttttcttaccttcttcagcaacaccagcaggtccctgatcttttctgtgacacctaagttttcctagctgcttgtcttctccatgcttacaaatgagagctccaaaatttcctttaaaaaacattacacagcctggattgaaagtgccctttacctttttttctactgatgattaaagtaatataagcccattctagtccgggcacggtggctcacacctgtactcccagcactttgggaggccaaggtgggtggatcacttgaggtcagaagttcaagaccagcctggccaacatgatgaaatcccatctctactagaaatacaaaaaattagctgggtttggtgaagcagaagaattgattgaacccaggaggcggaggttgcagtgagccgagattgcgccgctgcactccaacctgggtgacagagtgaaacttcgtcttaaaaaaaaataaatcggtaaagtaatataagcccattctagaaaatttagaaaatgaaaacaaattacataaaatatcattacccataaacaacttgctatagttaccactctgacatatgtctttc

SEQ ID NO: 137435 - DNA, 1070 bp, Homo sapiens
tgtgaggggggtttggaacagtgcctggtacatagtaggtacttaattgatacctaatactactttgctactcgagcttggatagcttgcaatctagtgacttcactacatctgctgtagaagttaaacgctgagatgatagtgccctctcatttgccagagctgtttttgtttttaacaatctcactaggcctttctttactattctgtaccaatcaactcctgttctctgtcctttctagttggaaggacatggttagaaccatggagataaaagagtaagatagaacctgtgaccttaaaacttgaagatgatggtattgtcaaattagttctgtgactgtgtcatctgtctctgtgctataagagtgaagaggaggggaattatcaaggaatttgtccaagaggtggcaggcctatggaaagtattcagaacattgggaaagagaggcagtaaggcattctaggcagggaaaccaagtgagcaaagacagggaaggaggagtaatcttggaaatgggtagttaggaaattagcctgttaggagagaggtattgcggaattgtgagaggaattcatgagattcttactctattgtttttcattacctactccagaatatttagtgaaagaagtcctatacctggaatcatgagacttttgttctaatcttggttcggctgcaattagctaggtcaagtcatttatcccctctaggcctcagttgcctatgtgataaaatgaataattggattagttcagtgattcttaattggaggtgtgcatgagaacctactggaaactgttttgaaatgtaggtgtttggatcacactcaagacattgttccaggctgggtacagtggctcacgcctgtaatcccagcactttgggaggccaaggccggtggatcacctggggtcaggagtttgagaccagcctggccaacatggtgaaaccccgtctctactaaaaatacaaaaattagccaggtgtggtggcatgcgcccgtagccccggctactcaggaggctgaggcaggagaattgcttgaacctgggacatggaggtt

SEQ ID NO: 137436 - DNA, 2486 bp, Homo sapiens
attacctcatcatcctcgcaataacctatgaaagcagtattatccctgttttccaaatgaggaaactgaggcacgggcttagaaacttgcccaaagtcacccagagataagtggcagggctgagatttgtgcctatgtggtcttcctccaaagctcatactctaaacaacagtgctgctctaaaatgaatctttctaaagtgccactgtgattagatcatttccccactcagctaaactcttccttggctcctgggtaaagacgtgttcaggtcattcacttacttttttatttgagtgcttgctgtaggctaagtactagctgcttgctgaggactgagaggtaaataaggggatcccgtcctcaaggaggacaaggtttagtgaaagagataataaattgcagatactgtgggctaattgcaagtgatgaaaaatgtggcccctatagggggcatggttaattttgagtaagggagtgaaagttggggaaggcttcaccgatggtgctaagccatgaagagggctgtagatagttcagatagcggacaagggtgtggagacccgaatagccagttatgagctctgaatagattttgattggaggttggcaggagagttgaacacttgagtatgggtttgtggtttccaaagttttttttgtttatataccccatcagtcaaaatctttagagaagcagcccttagtatatttttgtcatacttcactacacagtctcatttttaaaatcccagcagttaataaaaaagatggattgaatagatggatatgtgataaatcaggtatagtaaaaatagtagaatctcagtcacgggtattcagatgttcactgtaaaattatctcaactttgccatgtgtttgaagtttttcataataaaatgttggggaaaaattcccagcagtcctctttagtccttagaagcactcttggggaatgtataaatcttattccctgtgctagattataaacaaactctgatctttttgtattctccataatgtcctgtgtactttgggtgcagggtacattgtttttttccatagtgaataggtcaatgatcctaagagaatggattgtagaagtgactttttaagagtgtagtgtggctcttaatataatggatttaagaccagctccaaaattgcatatctaaagtgtctgtcgatgttactaatgagtgaagttctctctcggttctggtcagtgacttttttgttgttactggagtgataaagaactccctggattgtagcacagacttgaaagtattgattaataaccgattgtggtttcccttttcagaggagtgttctactgtcttgaaggtgggaatttttcacttggatgatctgcatgcctactatttcttttgactgaatgtcagtgcctcagaacaaaacccactactgtatctctcccctctttggttttgttcttcaggctagaccacaagatgggcctttattcccagtctcattttcatttgtgatacagaaagtagaggtggaaggattaaataatagataaattgctgggttgtctgtttagctttagacaacttcggacttcccatgaaaagatccagtgtgtattgctgggatgaattttttgatttggttggtttcatttatatgctctgcaaagctttgtaaatgataatcagtagaaggaaaattaagtaaacccacaaattgcttgcctgattgcttcctaagggtctcagaaataaagcaacctaaagcagttttagattgtgattcaggagataatttagggtgattaagggaatgaatgctttgttttaatggttactgtgtaattagaaaaaaatgatcagcacatcagactcaccatttcacagctatacttttttagaatgattatgattacataaaatgagttgatttaaagaaagctattaagttgcagtacgtggatatggcagaaatcatgttggtggcatatgaataaccagactttgagaacagataccattttgtgctttggttctctagaatacgataaagcaatggctgctatgcctcctgattgtttacttaccattagtcatagacattctgaaaagtcattgacttttctagatgctctagtcgttggaaaataatcaaaataataattacttcttaggcaacaagttgtatattaaaagcttttaaaatatctcatttaatcctcaagagcttgcaaggtgcatggtattctccccattttacagttgagtaactgaggtaaccaagaggtaaaataatttttctttgttctaagtactagtaagtggtggataaaaattattgttctaggtttatattgctcaaagtttacacaatcccaccatcctgtttccttcattttatacattcttgtgtatgatcgtacactgttattggctagacaatatgcatagaagacaatcataagtagattttttgagcacttagtttg

SEQ ID NO: 137437 - DNA, 1972 bp, Homo sapiens
acggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgattcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaaggtgagggaggggccggatcttaaataataagccccacacctattccctcccaactaaatacctaaccacctacccacttacccactaccctacctcccatctacccacccacctacccgcccaacagctaacctacctgcctaactaccctctaccattttatccatttacctcccccttcataccaccccctacggattcactcacctacatggccatatctctactcatgtcatcccagtagctccctttagcttcccttatccaattggcctaccactaggtttcagcagaatctagtcagaatttcttttgtagcctcatctttctcctggtgtcttctgcctcaaactgaaatgcctttaccctgcttttgccagttgacatctctctcctgtatctctttccaacctcgcagtaaatcacttaagcaggtgtgaactgaacacctttcttctacattgtttttccgtcttcacccactgctgcttttttacccatctgtgtccattcagcctttttcatttcaacatgcatcttcttcctcctgccttagcctaaacacataaaaacccactgattcagtcactgttcagcaagtattaactcactgagtgtaagggttttaaagacatgtgagacactgctcatgcccttggaaagttaaatgtatacacatgaaacatttaattatagcaatgtgtatgtgattatgccttatggtccagacagtaagtacagttcctgttttctgtatgtgggagtggtgggatatctttggactaaagtggtcaggggaggcttccctgaagaagtcggacctcacctgggtcttcaaaggtggattggatttgaatgagtcacaagcttgggaggaggctgctttaagtgggaggaagaaaatgagcagaagcaaaaaggaatattaagtgtgcaaggccccataggcagttaagtccaatctgcatgtagttgggtcactgcatatggggcctggggaacagcttggcagcatccccagttcttggcaccactgctgctgctctgttgctttcccatactcttaggtttcaagttcctacgtgtagagaatagcaaggcttgggaagtaaaggaggtgggcaggaagaagaaaaagaaaagtagtacagggttgggtagaaagaaaccgcaaacctatttccccaaccaaggttcttgggggttgtccttacagttagacagaacaggggattgtgggaatcacttaagaagtggtgtcggctggagtaatgaggaggaaagaaattttagctcagagactaaaagacctaaacagagaagcttgcagtggttatagagcttgtggctagagtcc

SEQ ID NO: 137438 - DNA, 1062 bp, Homo sapiens
agcaattctcctgcctcagccttcccagtagctgggattacaagtgtgcaccaccatgcctggctagtttttttgtatttttaatagacatggggtttcaccatgttggcctggctggtctcgaactcctgacctcaggtgatccacctgcctgggcctcccaaagtgctgggattacaggcgggagccaccaagcctggcctgcttccctttcttagggcatttagtaaaaaagggcttagtattgtaaatccttcctctgttcctttgagatgtttatgtatttcctacaaactacagagtgtttgtttctcaagggcctggaagccagtcctttgaaatgtagggtagggcctctgtctcccagtctctgggaggataaaaatctaacttcagtaattgccaggtagcagacacagctggcctaatcacatttatactgagaaaccctctgtaatttttcacttccatgacgctactgagtccctgcttgctttccttccctactccctcattttccctctaaaatgcccagtcacctctgtgcaaatcagaatgaagctcaactctttcctcttctgtcagtagttactgaataaaatctgtcttcactgctttaactaatgttacttaaaccacagatttctggccccacactcagagtttctgatcctggaggtctgaagtgaagcctgaaaatgtacatttctaatagtttgcaggtgatgctgatgtgcttgctccagagacatacttttgagaatcactgctctggtcaggcacggtggctcatgcctgtaatgccagcactttgggaggccaaggtgggcagattacttgaggccaggagttcgagaccaccctggccaacatggtaaaaccctgtctctactaaaaatacaaaaattagccaggcgtggtggcgcatgcctgtagtcccagctacttgggaggctgaggcagaagaatcacctgattgcttgaacctgggaggtgtaggttgcagtgagccgagatcgcgccactgtactccagcctggacgatagagtgagactccatct

SEQ ID NO: 137439 - DNA, 2069 bp, Homo sapiens
agcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtg

SEQ ID NO: 137440 - DNA, 1030 bp, Homo sapiens
gtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggctt

SEQ ID NO: 137441 - DNA, 1061 bp, Homo sapiens
ccaccatgcctggctaatttttgtatttttagtagagacagggtttcaccatgttggccaggctggtcttgaactcctgacctcgtgatccacccgcctcggcctcccaaagtgttgagattacaggtgtgagccactgcgcccagccaagaggaaacttttgagagtgaaagggagtactgttagcaattactccaggacaacagctttaaaccaggacgacgcaggtaaactagagtgtgtgttcaccctaattgcaccccatgtgtggctctgttaactgctttgttggccaaagagttatctgattatcagttttaattctttttcatggtttccctgttgttgttttttttgtcttatagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaagtaagttgtttatacccaattcactttgtttacaagaactaaaaccataaaaattgatgcgcttaggcctatagttacagtcactatgagagagtagtatgacttgataacatagagacttttatccttttttagattcattatgtctttgagcaaattatattttagaccatgagtcagtaaacttttggggggaaggagccagttagttaatattttaggcttttcaagctatactattacaactacttaactctgttatagtgcaaaagcagccatagagaatatgtaaccaaatgggcatggctttgttccattaaaaccttatttacaaaaagaggtggtgggctgtggtttgccgacccttgttttagactgttctatttttttaaaaaaatccagcaagtatcaaagaagaaagcgtctggaatgaaggttaattcagtccagtgtttcaagaagagtttgggttttaaggaaaagttttcctgtg

SEQ ID NO: 137442 - DNA, 1063 bp, Homo sapiens
cctttagaatctcagcaactctaattgtggaattttatttgagcaatatgatgcccactctctttacccaaggggcctgattgaaagagtgaatttgggggtatagattaaatttttaagttttgctagtatcaatacatatacatcacagcagagcatctacttgtctgtgctatgctaaccacttttacgtttttatatctcaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaagtaaggactgtttctcttttgtcacaaatctggttgccctaggttttatagaacttagtattggattggtaactaatttaggattggtgacattttaatgattgaaaactacaaagaatgctaatgctaaacatttatgaatgagaaaaagttcttatatataaaatgttttcatagtctcaagactattacagttgcttatttaccaatatgatttaactactctttttgctaacctttaca

SEQ ID NO: 137443 - DNA, 1116 bp, Homo sapiens
ctcatcgctttacatctattcaaagccctagtatcagctgtggactcccgtgtcagaggaatgggatcaggagcaattgctgatctcatctcttctgtttccactgcaagttttgccaaattgtaagtaaaaaagagaaaattgtttgttaagactaaatttgtttacattaccaaaaatgaagaaaagtagaaaaagcttaactcctgctagacaattaaaaggtgttaatgtaataagcaacattgtattaagtccctaagtctaaatcagacattgcaagatttatcccaagacttagtatctatatgaaatgaataaccggaaaaccaaattagttacaaaaggaaaaaataaaatggcaatgacattaatgggacatgtcacatacatgggctatgtggaaaaagtggcaagatttgtatatgaacaacaaaaaaaataagtaaatgaaaagtgatgttacctagtctatgtccctgactgtaagcacactaccttgacggacttttgatctcttgaaaaagctggttgactgccgtagcctgtatgcccagctttttaatttgcgagtccaggatttcttgctaataggatttttgagactaggacaagtaaagcttaggccaaaatatccacctcctgtctgcagatgaatggctccaccgcttgacacagcagcaggataggcctctggatcccctggaagtgaagcatctgaggacatctcctaatggagacaaaacaaaacaaaacaaaacaaaacaaaacaaaacaaaacaaaacaaccgagaaaaaccaaagtggtaataatttaggtaaggtgaagcttttaaaaaaaaaaaaaaacggaatttcttgtatagactaatctttaacccaaaatagagtattacgtatatagttgcattaatagtagcatatcagactgaacccaaagtactcaatttataaaaagccttgtttctttaaaaatattatttagactttagtaaataaaagagaagattattaatcttctaccccagaatatttttcatcattatacaaactttgaaaactgaaaatcaaattaaaatttccttcatatgtgccagtttactaaaaaggttacta

SEQ ID NO: 137444 - DNA, 1014 bp, Homo sapiens
ctgtctgtaagtgttttatgtaattaccgtaactttccttcagtaattgtgggaaaggtatgggacatgctccctggcactgtattttgtaacttatctctaatgctgcctggagggtggcccagtagctagtctccaaatgtaggagggcttacctttcttcctggatgtcgtctccttcctacatcgttgacctctttcttggccacaaaaccttttcctcttactgctcttatttgggggcgcatgcctctgctgccctttgcttggtctggaggtggggagagaagggacagaactgcctgcctgttccttctttgttatcccaaccagttcattcttccattcagtaaatatctctttagcagtgaataagtcaaaacctctgtttttgtggagtttacatctagtagaagaaaatggatactaaacctatatatggtagtcagggaaagacttgtatgtgatggtgacagtcataggcagagatctgttcaaggaaccaaaaggcggccagtaaacaggagagcattaagagataacattgaaagagacagaagatagatctgatagagttttgtaagcattctagcctaccactcatctttttagttggccagggttctctcctgctgcccgtatcagccactcaggtttgcagcattttgaaacaattcctacatatgtcatggtctactttttcctctgtcagtcatatatgcatgtgtctatgtatattttcctgttgtgtctgtaaatttggattgataaggaaggctagaacaaatatttaatttgccatcttgatccagttactacatattaaaattcttttctgtaatttcagtgggaccaatgtaacattttctaaattgtaatactgatttttttcttctcatgaaactaattattactagtttaaaatgagacttcagaaagtaaaaactgattgcttacaattttatttttaatatgtcctgacctgccataagtttgtgtttgtttttttgtttt

SEQ ID NO: 137445 - DNA, 1038 bp, Homo sapiens
ctgcggttcctggccgacatccacttcctagtaagcttttcttctctgccagctttgtccagactcaaaggatgggatgcaaaatacatatgatatctttaactggtttccatgggaattttatgcttatgagaattttcataagcttttttgaagacattaatattaggatacaacttaagccatttcctatttaatatttatgagaaaaaaggaaaacattatttcccttgacaggttgaattctgtgttttgagtcttatttacgagagtactttcacacaggttctcatttgcccctttgtcctcctgttccttttgacttagggtactagtctgtgctttgtactcgtcagtacgtgcttagccattctttattattgttccaggtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgct

SEQ ID NO: 137446 - DNA, 1026 bp, Homo sapiens
ctgattatttccttattagatccataggagacggattcatggatcagaatatgaagatttttaaagtttctagatacatgttgctagattgctgtccataaagattggtccaggttacatttccatttgcagtgcctcttcttttgcttagagtcaatttatagattaagataattttggaaatgaattattaaatttaaatctttgcattgcagatagctctagtgactattataactttttttgctttcttataaaagttgtattgttttctttaccacaggatcacatttataacttattttttactgagtaacttgaacctgttagtttagtcatagaatggctgtttagatggtattccaccaagggaaaacattctgaactatttaagccattttccacatatattgtacgtgaactagtgtagatgttccttgcacaatttgcaaaaagaagacagtgattgactcttaaaccggtaaaatgtttgtactcaggtatcaacctctggagataacatggtagagtgtcagctggagacacacaacaacaagatggtcaccttcaagtttgatgttgatggtgatgcgccagaggatattgcagactatatggtaagtgcagtaagaccaaattatcttcccttcagcattctgtcttttttcccctataattctgtctccatttattttgagccattgttttttagagtacgattagttttaaaattttgtacagaggtaaattgggttatcatcaagtgtaagtcactgcatctcctccggtttcagtatatttaactggaaaatatgcagaggtttcatttagagataatatagctaaatggctcttatctctgattgcatgtgaaaatcacctgacaagctttttaaaaacaattgtattgcctggtcccttgattaaatcagaatatttggaggtgaggcccaagcatcaatagtttgtaaagctccccaggtaattcttttttttttagtttattttttgctgggcacagtggct

SEQ ID NO: 137447 - DNA, 1108 bp, Homo sapiens
cattacataaacaagtatattttgagtgataatttgttttggttttagaagttttgtttgaagatattaataaagtaaccaaacaaacaagataaaactgatcaagagcaccctataataaaaggctccacagaggtctatcactggcaatatttttctttcattctcatcactgtgagatggtttgctaaatgctaaataaatacagtgtgaccttgatttttcagctttttaagaaagctttattgaaatataattcacataccatataattcactcatttaaagtgtgtaatttaatggcttttagtatattcacagagttgtgcagtcataacttttaaaaagattgtagtattaatttttcttaaattcattatttatagttttataattgggagtttttcttagaattttactgtcaagactggaatgagttacttttttaaaaatattactagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtcagtttgtaaatatggtttggttaagagtacatatagaggtctggagggtcagagaggggcagtgctgcagaagtgagttgtagaatattgcgagaccctctctaaactaaccttttctccgttacagactttccaatgtgagtattatgtgttcgttgttaaacttaggaaatataagaaagaaaataaaatctacttttaaccaccattcagagatagctcctattaatgttttagtttgtttttctctccttttcctgtatgtacatgtagtgttttacattattgaggttgtaatagtactagtaatcgcagcaaaaatctattgagttcttttgtggtaggcaccctaaatgttatccatgcattttaccatttaatccttcaataaccctgtatgataggtcatagtatatactcatctttacaaatgaagatactaaagatcagaggagtgagccgggcgcagtggctcacgcctgtaatcccaacacttt

SEQ ID NO: 137448 - DNA, 1046 bp, Homo sapiens
ataaatatgtaaacaaataggcgcggctgtgttccaataaacatttgctcacaaaaacaggtggtgtgccagatttggcctgaaggctgtggcttgcccacctgatagagaatattgccattactccagaaagttccctcatgccccttcccagtgagttttctccacacccgttagagtcaatcgctgttgattatttgttgttgttttttgagacaaggtcttcctcttttgcccaggctggagtgtagtggtgcaaacacagctcactgcagccctgacctcctggctcaagccatccttgcacctcagcctcctgagtagctgggaccacaggtgcgcaccactccgcctggctaagtttttgatttttttatagagacggggtcttgccatgttgcccaggctggtcttgaactcctaggctcatagggtcttcccacgttggcttcccaaagtgctggaattacagatgtaagtcaccatgcctagccaattttttcaccatagattagcttagcctgttctagaccttcatataaatggaacaatataatatatattcttgtgtaaggcttctctgattcaacatgtttttgagattgatccatgttgtgtatgtatcagtagctttttttttttcttttttgagacggagttcgttcttgttgctcaggctggagtgcaatggcttgatctcggctcactgcaacctccacctcctgggttcaagtgattctcctgcctcagcctcccaagtagctgggagtacaggcatgagccaccacgcccggctaattttgtatttttagtagagacggggtttctccgtgttggtcaggctggtctggaactcctgacctcaggtgatctgccagcctcagcctcccaaactgctgggattataggcacaagccaccatgcccagccagctcattcttttttgtaactgcagaataatgttccattttatggatataccaaatttgtttatctatcctattcacagacacctaagtgatttctggttttgggctattgtgaat

SEQ ID NO: 137449 - DNA, 1006 bp, Homo sapiens
ttctgtaaagtactttgactagattattgttaatggagacagtgacttctatttataacattcgtaaaaagagtttgaatttttaacgtactttagagtttataaatctgcaagtttttggttccctttgctgagaatctactgtttgagtctgagtaacttaagccagtggcttagggaaatttgcctaacatgtactaagctacttctccagttctcactaggcataattttgtgtatgttaaactttgttatttagatgtattacttgtaagaattcatttttaattgaagtcactccgtatgcatgttagttgggatttctttgcatccctggtaataaattggatataagatttattgttgtttttgcttccacaggatctgttaaagagatttggtttttataacaaggcagattaatgattaaattgatagaaaatttcaaataagttttttgcttttatacaattaatttttagtaattaaagggtcttgctatgattggaagaactgataatgagatatatgttttgtttattaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtaagttaatcataccactattcccctcacctcttattgtatcagagttcattccttgctccttctcattgctttctttcctctcattttctccttttttttgagacagagtctcgctctgtcacccaggctggagtgcagtggtgcgatctcggctcactgcaagctccgcctcctgggttcatgccaatctcctgcctcagcctcctgagtagctgggactacaggagcccgccaccacg

SEQ ID NO: 137450 - DNA, 1043 bp, Homo sapiens
ttaaataaattatttcagtgctttatgtagatatagcaaatattcaacaaattgtatacttaaaaatttgcggccaggcatggtggcccacgcctgtaatcccagcactttgggagcctgaggcgggtggatcacgaggtcaggagttcgagaccagcctggccaacatggtgaaaccccgtctctactaaaaatacaaaaattagccaggcatggtggcaggcgcttgtaatcccagctacccgggaggctgaggcaggagaatcacttgaacccgggtggcagaggttgcagtgagctgagatggcaccactgcactccagcctgggcaacagagcaagactatgtctcaaaaaaaaaaaagaaatttgctttgggggagtagaaattaacacagataatccttataggaaaggggatgtgatcttggtggatacgtttttctcttctataagaatgtggtggtggtgttattttgtaggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtgtaggtataacttttttctttttactttatcagttgccacgtttcatgttgaaattagttaagtttgacttactcaaaactaattttggtttagctctaggtaacagtattaaaattaacaattgtaatgcaacaagccttagatttataccatatgactatgcttcattggagtcatataaaatgctctgtattagtatctttgggaaaatgtacaggtatatcatctatatatatttgtttgtaaggaatttttagttatctattagatggatcttatttttcaaagctgaataatagagaccgactacatggtttcttctaggtctaaaagcctttttatgaaagggcattcaaaatatagttcaatagatacagtatttgggtccctgctatgagtaaat

SEQ ID NO: 137451 - DNA, 1076 bp, Homo sapiens
aaaaatggcacaatagagtatagcaggttgacacgttgagtgagcattctaatatactttcattatagtaatgaatatactcaaagcaatgcagtggaagtaacagcttaaaaatccatacttccacacctgaagcatctatcaaaattgtggaagaacttatttctattttattttcattcatcatctaagtatactttggggaaaactatattttgagacattagccctattacatttgattgtgaaattagaattagatacgaaaacagttgaatttccaataaaggaaaaagtaatttaaaaagatgctagaatttctgtttctgaatatagttgtttacagtattcgcactgggacatttaattttgctccccaaatatttttatgtccctcttggaaatgtttctggattctgtttagccgtgtaagaaagtgcttcattacattataggcacacgccaaatagtctgattcagtttgatttcccactctcttcatcagatccagccctaaaagtagaattcagtcatggacaaagcgtgattacattgaagggaggagggatagagcttgcttaaatatacatgttctcatctctgtttaaaaactagtcacgaactttattaaatataaaccaaaggcaaatgcttttacaaaatgacaaagggtgggagtggcaggagatagcctttgtctgggaaatagcattaatttccccagttagttgagtgagttagttttgagctaattatttgcttgatagatttaaaaaattgatacatgtggtaagctgaaaatagccccccaaagatgtccatgtcctaatccctggaacctgtgaatatgtcatcttacatttcaaaaaggactttgcagatgcgattaacttaaagatctagggattggaagattaccctggattatctgggtggacccagtgtaatcacaagggtccttataagagggaggcagaatggccatagtcagaggaggagatctgatgatggaagcagaggctggagtgatgcagttgctgacaatgagccaacgaatgtggacagtctccagaagc

SEQ ID NO: 137452 - DNA, 1072 bp, Homo sapiens
ttgttttacttactgtgtttgtcacattgtggctaagtgaactcagggtttgggtactcattttgaatttgatggattgacagatggagctgagaactaggtttctaaccaatattcatgcaatatgaagacagattgagctatatactaagtagtctgctagacactgaggactaatggtaaacaagataagacacagtccctagagtctgctggttcctaagattggacagaaaaaagaataaacttcttattaaggaaaaagggattaaaaaatcaggtgatttgttttctccttaatgatttcctttgtagggtgattttaaaatatctttttcccccccttcaggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggtaggtatataatcttcttggttataataaattcaagttttagctggcctggccttctgtgtgattc

SEQ ID NO: 137453 - DNA, 1032 bp, Homo sapiens
gagacagggtttctccatgttggtcaggctggtctccaactcctgacctcaggtgatccgcctgtcttgacttcccaaagagctgggattacaagtatgagccactgcgcctggccccattttaaccattttaaagtgtacagttgtacagtggcattaggtaacttcacaatgttgtgcagctaacaccacctcaaaaggaaattctgttcccagtaagcagtcactccccattgtcccttcctccaagtcccaggtgaccattaatgtttgtctattctgcatatttcacataaatggaatcatataatatatgaccttttgtgtctggctttcactcagcatgtttttgagattcatctgtgttatggcatgtaacattactttattcctttttatggctgagtattattcctttgtatggatataccgtattttgtttatccatttatcagttcatagatatttgggatgtttccaccttttggcttttgtgaatagtgctgctatgaatatttgtatacaagtttttgtttgaatacctgttttcatttattttgggtatacctaggagcgcaactgctaggtcatatataatcctatgttatgttttgttttgagacagggctctgttgcccaggctggagtacagtggcatgatcatggcttagtgcagtttcaaccacccaggctgaggcaatcttcccacctcagcctcctgagtagctgggactataggtgtgtgtcaccacgccccacaccaggctaattttttacatttggtagagacaaggtctccctgtgttgcctgggctggtcataaactcctgagctcaagtgatcctcctgccttagcctctcaaagtatgggggttacaggcatgaaccactgtgcctggccctatgtttaacttgttgagaaaccaccaaaccgttttccatagcagttgcaccaattttcattgccatcagccatgtatgagggttccatttctccacatcctcaccaacacttgttgctttctgtttttt

SEQ ID NO: 137454 - DNA, 1065 bp, Homo sapiens
aggctcaaggagattctgaggtgttatttgggaaggggtggtgtgtgttgtgtgactgacaggttggggatggggaggagatggtatgataggtgaggatgaaagtggtgaggtggcttcactgtactgaaagaggttttgtttgactagttaaaagtggtgaaacatttatataatggggtgggggtggaaatcctgcacgtgagtatctccgtatcttgggggttgagagactgttaaaatgagactgaaccctcaaaacagatgcgaatagtatggctattttttcttaagagttactgttgattgagacaattatatgaataaaacagcttttgagttgtgaaaatcttctgcatagtagtgattgtatccaatttttggagataccgttatctgtttttcatctatagtaagttgtaataccaagagaacttttgaagaggtcttagtatgtgacagagcagcgggtgtcttttaagacggtctctatcctttggattgatgagtttaaaaattgtttaaactcgacagctcaagggaaagataccttgcattaaaggatagcaaaaatgcactaaagcttagccgggcgtggtggagcgtgcctgtaatcccagctacttgggaggctgaggcagaagaatctcttgaacctgggaggcagaggttgcagctagccaagattgtgccactgcactctagcctgggcgacagagcgagactctgtcttaaaaaatccactaaagctgactttgaactaaaataattgtacattttttttggtcattacgaatttatctttgaaaattggcactcgctttttggtgtgagtttaaattacaacagattacgtgaacattttgttctctgaatacttatcttctgataaggatgtcttgtcctggtctcattctgttctgggtcaagattaacggttatggattttaatcttttgtgattattttttacacattttactgatatatatttagttttcttggaaatgttgcaaacttgagaacattcccatgctgtttttcttttattctgctttgatattgg

SEQ ID NO: 137455 - DNA, 1065 bp, Homo sapiens
ttggacttttcttcttcttcttcttctctgaggggagagggtagagcagctgagagagagcgagagcgcttcggaacacacaggagatgtcgcgcgtgcttcctctaagagattttctctttggaatggggagaagcctttctcctcgacgcgcatccctctctcccgcggcgccgaggggggcgggaggcgtgcgcgcactctagttggctggccactcggcacctcgctgcgataggggcggttccgagttggggctgctccgttggctttctccgcccctccccctcttctgttctcccctcccttccccgccccccctccgcccctctctcctacccgtccgaattccctggctggagtacgcgtgcgtctgctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggtgagggtcccgggccggccggggcgctaggagagagggaggaggccggggggcgtgtctgggatcgggctgagagatgaatgggccagggatgaatggagggaggcagcggcggccaagagtctgttaggagtaagcgccctagcggggggcggcttgaccgaagcagggtgagtgccttcaccagtcggtaccggacgaggccgggctccgggctaaggggctgtcgaaactgctgaataggcggagaggaaaatgaacagggggaaagtggggaagggcaggtttgaggctgaggtgcgttttttgttttgttttcttttttgtttttgattttttttttggttgttgttgaggggtgacaacttt

SEQ ID NO: 137456 - DNA, 1047 bp, Homo sapiens
ggaggatcccttgaggccaggagttcgagacgggcctgggcaacacagagtcttcatctctttaaaaaaaaaaaaaaaaaaagcaaagactgcatgattccacgtatatgaggtacgtagaataatcaaaattatagagatagaaagtagaatggtggttaccagggactggggggagggaagaatggggagttgtttaatgggcacaaaatttcagttttataagaggaagacagttctggagatggttgcacaacaatgtgaatgcacttaatgccattgaactgtacacttaaaaatggttaaggtggggagtatatattcaggacaatttgaatctatgctcccatgaaaaaaaatttacagaaaaaaatggttaaaatggtagcttttatattatgtgtattttatcacaattaaaaaaatttttaaagaagggctgacctacaaagccacttctggcccttgccacctctctagcctcatttgacctcctccccctcactttgttccccaacaatcagggaacaatctgttcccctgggcgtattgttcacctctggaccttgataagatgttctttctgcctcgaatgctcctcccacccttttgcctaatgtcgaatgtccctttctcagggcaaacctttcctgacactaaagaccagcttggggcccaactgtacatcatcatggtatcctgtactttttcttcctagcatttattgcagttaaatacttgtacaattgattatttaatgtttatatctccaactagaatgtcagttccacaaagacagggactgtgtctattttgtttactgctatattctgttagaacagttagatactcagtaaacatttgctgactgtctgaatagatgacctacttattgctggttcaagctcctcacattctataatccagagcctgtgagcctcagccttgtggatccagaaacctgactttgaagaacacacagagctgattcaactcagagctgggccacatgagcaaactgtacacttgattactccacaaagcata

SEQ ID NO: 137457 - DNA, 1884 bp, Homo sapiens
ttggacagcaaagatctacactgtaggctcgtcttgagggatatacaagaacaagaggcccagtagagggcctgttgcatagtatggtttttaaaaaaatcttcattcaatttctagctttggagatgacattaggcagagtcatctctctcaagaaagtatactatccattgaggatccacacacgtaaatagttacaacattgatagattttctgataaagaggagctcagggtgcatggggtaacaggatggggagacagcttcttagtggaggtggtgaattgggctgggtcttagtgagaaggagttaactaggtgggggaagcagagagagcaacactcaagttctgtggcatgagggtataatgtgttatatttggaaagtagcagggagctcagtattggagtatgggcgtgtgtgcgtggggggtggaggagtggtagagaatgaagctggggtgtgggaagcccccttgaaaagcataagacatggaagcccttatgtgcctttgattttatcatttaggccagtgtttgccaaaattcatgctaactagttctgttagatgttcagtgaagaagcttctccagttaccttatgtaagaaaaactcttgttctgctcccactgaaaagtcttaacactcatgaacatattaaaggcttgggtaagaataagaaccactaaaaaacctgtttgcttttgtttctcattagctttctatggatagtgtcccttaagacccagcagaacagatatttctcaaaggcaaactgtgaaacactgcagtggctggtaaaaattcgtgggcaggttctagggtgagaaataggatgggatttgctggctagaaagttcaggaaataatcagtatgaagcataacctggagagggaaagactgatgagaacgctgtttttgtctagaaactgatgaggcctgaagtaggacagtggcaacaggcatggaaaagaaggggtggaatagggccttggagattggttggctgtagacagggagggaaaaagaggcaagttcctggtttgagttgatgggtggattaggtgtcttttctcggagtagaggaaccctggaggatgcgaagcaggtttaaagagtaaggtgatgagtctggctttagatatggaagatctgcggcatctgtgaaacgtccaggcacagagtagtctcagttggagataaattcgggggatattaagtttgagtggtagggaaagccaagagtgtggatgagctctcccagagaaagcacatagaggggagagggctaggagctttgtgggagactttcttgagttactgtctaattcagaaaaagtagagcataggcccataggtaactgaagcccagagaggaaggtggctcagtcagagtcacacagtaggatgtcagtgtcaaggctatgatgatttcatcattggaattactatgtccatttcttcttaactatcccattggtctgtggcttcttttatcagtggaaccacagttgtgaaggttctcttcacttcaaaaacttcagcttttgcatgatagaaattaacatggatcatggatcttcactgtgctaggcattgtgttggatggttcctcataacagacctttgaggaggccaccattagccccactttacagatgagaaaactgaggctcagaaagaagtagcttgctcaaggtctcatagaggggaggctagttagaatagtccagatgaaagagggtgagtgtagggctgggagttgtggaaagaggccttggtaggatggaagagattggaaatgaggtattaatatttagtggttctttaaaaaattatgttaaaacctggaatgcagaacactttagcagataaaaggcag

SEQ ID NO: 137458 - DNA, 1064 bp, Homo sapiens
acccagggggcacccacttcacctccatctcttccacactgtccacatcatcttcatcctcatcagtctctctagctgtcttaagtgcagtggctgtgaccttgcattttctctgagtgatgcaggaggccatctccctcagagcagccccatcacccctctggaagtggtggaacatggtctgcagttgctggctcacctaccaagaaaatattcaaccagtttggattttccagatatctactatacaaacagcacgtgtttgaagcaacagtggggagtaggttggatttttccagaagagaacagagctctttcctccccaaggaattaaccaatgaagcaaccacatatgaagggctcaaatgaaggcctaaagcatcaaaagagagcctaactagcagggaatcctctagaactgggctttgaaagaaataagatgtaaaagggaaggtaatcttattggggagcaatggtaaccagagcgggggtgaaaatggacctggactggcctgacctgcccttgggatggggctgaggaacaggcctggatgggaatgatgtatagaaataaagaaaaggcagggtttggaaaggctacactttttcctctaggcaacagagtcatagtcaagagtcttggcccaaaacagacagctggggagaagaaagactacaggtagggagactgcagttgtgcccgtgataagctcacctggggcagactcccgtcttccacaactgtatcaaactcgttggtcaacagctctccaaggaagtcttccacctcatctagctccaagtcagctaagtagaaaaggacagggcccttgggtcaaagaccagccaacttcatcacccctgcccactgctcttcaatatctacttggtggatctgcaactgggtgggtaaaggcacagtgagccttttatctgctaaagtgttctgcattccaggttttaacaattttttaagaaccactaaaaatacctcatttccaatctcttccatcctgccttttatctgctaaagtgttctgcattccaggttttaacataatttt

SEQ ID NO: 137459 - DNA, 1967 bp, Homo sapiens
aggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtgaagtgggtgccccctgggttgggggatacagatgttttcaattttctggaagagcagctagattcacagggaagtgataaggggatggtggtggttggtggtagtagtattatccagagagggcagggaactttcctaaagttacacagccaatcctggaaaagctggagcagagcctgggtctccagtggtcagtgtattcagctctcttttaaatctcccctccaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttttttttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttcttaaaaaaaaaaaaacacacaaaaaaacacaaaaaactgagtatccattgtcctcccccctgtttccctgtcctgcccgctggccctgccatgggtctggacgataaaatactgggtagccttggggccgggtagaagctgtaagccatgggagaggcaggagaggtctagttgccaccccacgtggagttgtacgtgtgaagacactggctgaggaggcagggctgggtcggggccccagggtcagtggcagagctggcacttgaatccaggtctcctacctctggtgctttgtggggaactgggtggaggcaggatctgtggtagggtattgagggatgagggagaaaaacgacctaattcaggtaggactggcaacggctcccaccctccctggggacagggattaataaaaattgacatcactgtaggaatatattttttaaaagcccacgttttgtgaaaagatgaattaaaaaacccaaga

SEQ ID NO: 137460 - DNA, 1113 bp, Homo sapiens
cgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactttcatagcactgctgtgctccgttcgttcatctgtttggttgtccaaagtaccaggctgctagggtgggcccagaaactgctcccttgtaaactctgaagctgagctcccagaaggctgattctaaggctactactcacaggtcaagccacagattaagcagtaaggtattatttattaagatcttaagcctcacccctgaactcaaatgggatgggataaggagtaaggaaagaggttagaggagacagaaaacaaagcccagctcttccaagctcaccacctagccaaggtcttcgaattcctgagggaacccaggactggag

SEQ ID NO: 137461 - DNA, 1083 bp, Homo sapiens
gacaccgggcatcaatgttgacagaaggcctagcctggctcctcctagctttaatacctcctcagtgtagggactgctattcctatctcagatgaagacgctcaagctcaggtggcaggagtgatttgtccagtgccacccagtgaatcagctagagctgagattcaaagctaggttcgtctgcctcatttgggcaacggctgctgcctctacaggccagtggaaggagtgtgcggatctcaggcattctttcttcagtcagagcattcattcctcaagccattcacacatttaggcctcatgcttttttctgtctttcatcacatccatttcctacactcattgagaggtaatctagcattgtggttttaagggggtatgtgggtggttaatgaagtctggcttagaatcccagctctagatgaaaatgtattgacttggagagcaaagagagctgatgtgagaattaaatgaattaatatatgcaaagtgcttagaatagttcctggcacagagtaagtactcttttaagtgttaaataaatacctagatttgtttttaaaaaaatctccaaaatgtgtgtttgtgcatatatgcctagaaagataggataagccctcacaatggtaacttttgggtagaagggatacggtattttattattttttgtttatattggtctacttatcctactttgtaataacaaaagacaatttttaaattttttttttttttttgagacggagttttgctgttgttgcccaggctggagtacaatggcgcgatcttggctcaccgcaacctctgcttcccaggttcaagcgatttgcctgcctcagccctcccaagtagctgggattgcaggcgtgcgccaccatgcctggctaattttgtgtttttagtagagatggggtttctccacattggtcaggctggtcctgaactcccgacctccggtgattcacccgcctcagcctcccaaagtgctgggattacaggcatgagccactgtgcccagccaattttttaattttaaaaaaatccagtgctgccactcatttgctgtgtaatttgggcaaatga

SEQ ID NO: 137462 - DNA, 1751 bp, Homo sapiens
cccggctaatttttgtacttttagtagagacagaatttcaccatgttggccgggctggtctccaattcctgacctcaagtgatccacccgccttgacctctcaaagtgctgggattacaggtgtgagccacccacacccggccaactgataattattgacacggtttcttttatgttctatattctctcccacacatttcacccttacccctctacctgaggcctagcacctccttgaaaagtcctcacccaaacttcagactggggcatgtcacctcctctgggctccttggccttattttcaccatcaaaacactgatctccctgtattgtccctgtctatttcctctactagaccatgagctccttgagggcagggtcctctctgaagctcaagttcttagcacagggtctggaaagtattagtaatcgttgaataaataaacccaggcagattatgtgacttgcccaaggtcatataagtaataggtgaagaagagggtcaagcccaggtctttctgactccaaaacacctgctcttccactcctattgctttttgtgggcctacctaaccaaacatctttcttttttattccccaccccaaggactgaggaggagaagaaagactgggtccaggtaacatccaaggctctgtggtagggggctagaagagtattaacaggtctcctaggggttgatagattctccctcaaaactcacagctaaccagaatggtcctggacaactgtctttcagcaaactttactatccccattttacagataagcaaactgaggtgcagaggttgagcagaaactcacaaactcttcttttaggaagctggtttctctgagggtgtataaggtgagggtgtcaagctctgtaaaatcttaagcccagaaggtggccaggaaagccacctgaggtttttcagccaccactccccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagactttcaaactgttgaactcaacaaacagggaagatgaagacaccccacccaactctccagtaagagtccccgccctctttcccctgcactgggaccccttccagacttccaaatgcccacctgacctttagatgatcctctccctttcctagacggtaatgaccagagaggcaatgcatgacttcagaagcagtcttccattggtagggccacagagaaatcattggggaaactgaggcccagaaagtataatagaagtgacttgtcttcagtagcacagctaggagcagagccaggacttaaaggcaggtcttctgaatgtggctgctccccctacccccagcccatccccaccccatgataatccaagcgttggagcaggaacaagggctggctggactgggctggggagtagctgtctctgacctgagacctggccctccctacagaacgtggatcttgggaagcgggcacctacgcccatccgggaaaaggaagtcaccatgtgcatgcgctgccaggagcccttcaattctatcaccaaacgcaggcaccactgc

SEQ ID NO: 137463 - DNA, 1044 bp, Homo sapiens
ttaaaataatagcatgggatgatggccagccatttaacagaggggcctttcatatccattctctacttcgatgattataatcatagctcatatttcctcaagacttagttttttgccaggtgctgttttaagttaatgttaacttaaaattttaagtctaagttgactagtcaaaagcttacaagagccctagaagtagctactgttaccataaatctactttacaaatggggaaacttaggtgtaggacagttctgcatgcagggcgcagtggctcacgcctgtaatcccagcactttgggaggccaaggtaggaggatcacttgaggccaggagttcgagaccagcctgggcaacataacgagacctcgcctcttaaaaaagaaagaagaaagaaagaaaaagaatatttatgtacttgcccaagatcccagagcaagaaaggagcagagctgagattggagctcaggtcatccggccctggagtccacattcctaaccactgtctatgctgccttctgagggaccaggtgaaagggtatcagggtcatggtgagggccagaggatggatgcatgtcagcagatggcctgcttctgacaggctgtgagaaagtgagaaatgactggctgggactgcaaggaggtgggagagagagatgaatgtgagatagagggtatcctcctgggggatgaagtgagtcttgaagcttggggagattgagagcctcatggaggcctgcagcagggaaagtgagagcaaagcagatgccctgcacatccaggggagtgacaagccacgtgacagggactcatcatctgcagagaggaaaggggctgcagtgggacactgggcccagaaggggcagccaagcaatgtaggatttcctcctagtggcagcaggaaggcatggagggtttgctttgctttgcagtcacttttactgcccttaaaagaaaaaagaaatttaatgcaaattttcaaatatccggaaaagtgtaagtacaacaagcacccagatgcccacaacttagacagctgcttc

SEQ ID NO: 137464 - DNA, 3329 bp, Homo sapiens
gcccggcccctgaaaggcatgtggatgcctgagctgggacaggggccatagatctccgtgagcaccaaaacttggtcatgaagagagagcctcttaggaaaacacgacttggttggccagccatatggacctccttcagaagcacctctgctcctctagcacaggctgatctgagtggggagatccagcacatacagaatggggtacacaaagactgtggccaggccttaagcatgggtgggatttattagtgtgtggagatgtacagggactcatttcagctttttctttttttttttttgatgatacctggtcactataggaaatatggaaattacagaaaaagatgaaagaagtaggaaaaaaatcccctgttatctgagcccccagagaataagcacaatgaacattgtgacataaattcttcctggtgttttttagacatgtatacttgtaaaagtaagatcattctatataaacatgtttgtatccttttcttaaaacaccctgagcatttcccagattattaaaagacctacatgaggatcatttgtaaaggttgtttaatgttccattatatgaagacaccataatgtatttaactgaacccctacagttggccattttttttggcagggaagaggtacaggtgaaggtgtgctcccctacagatggacatttttgtttcccacttggaactgttgtaaataccaatatgacaaaaatgtgtttgtgtatagaatgtgtattttcctagaatagatacccagaatcagaatcattgagacaaagaacaggatcatctcattgtttctttatatggctttttctgattataaaagtaatacatgttctttgtcaaaaatacggaaaatacagaaaaacctaaagaagacaataaaaaccacccacggccccaccaaccagagacaacatgggtatgcttccttctggttacatatgtaactattattgttattattaatggtaataataatcttggcaagcttgcatttttttattggctgccaactactccatctattgtgattctggcattgtgacattggacaacttctgattttaaatgatgttgctgtggacatctttgagggtggagctttctgagatgggagggtgtgatcaggccaggaggaggtattcagggaggaaagaagccccgaggccgggtgcggtggctcacgcctgtaatcccagcactttgggaggctgaggtgggtggttcacaaggtcaggagttcgagaccagcctggccaacatagtgaagccccgtctctactaaaaatacaaaaattagccaggcatggtggcacgtgcctgtagtcccagctacttgggaggctgaggcaggagaatcgcttgaacccgggaggcagaggttgtggtgagccgtgatcatgccgctgcactccagcctgggcaacagagtgagactccgtctcaaaaaaaaaaaacaaaaaacaaagccccggaaaggctcctctctgctagtcccccatctgacctcacccctctatgcctgtagagtctctggagctgatcgccacagcagcagagcactcgaatgctgccatccgcaaaatggtgagtggcccttctagcccctgcccttccttggccacccacctgtggtgtctccatcctggagtgggggtgtcgtgacttgtgggcatctgacaggaggctggcaccccaaccgtgccttttgttccctgtcttttgccaggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactagtaagtgccaggcatggaattgtgggtgggtcatgcccctcccaacacacacacacatagtgacctggtactcactcaaagactatacctcctttcattcctgaaagaggaaaaaaaagaaaaacagactatacctcctgctagtcattctctcctctagtaacgaattgtattttcactacctagctaggattttttttctccactttacagatgaggcaaataagccttgcagagaagtgacttgcccgaggttccccactaggaagtgtcttccatgcctaggctctttccttgtgacccctgtgcccaatttgggctgtcttttctccatctattgcctacagtccttggcagtaaagcttcagggcaaggagctgggccacatccccactaggccctctgcacatacatcccaaactttttccttcctagttcaacgaccgcctcctttactgcgtgcccaggctgcggctccttggccagaagtttagcgtgcgggcacgcattgatgtagatggcatggaggtaagcatccaagaggtgggaaatgggaacttggagtggggcattggtgttgggaggaacaaagatgctggctttgaccccgagtctgtgtgtgtatgtgtgcagagggctagggccctgtggagttcagtggcctcaccatgcccctttctgcctccattcagctaaaggagagctccaacctcaatctgcctcgaaccttcctggtgtcaggaaagcagcgctccctcgagctccaggccaggtacttatccttgcctatgcctttcctccagcgcctacctcccttttgttcagatatgctgaggcattccaggcccagagattgttccagagaaaggatgggcacctttccccaaagatgcaggcttgctcttcagcggtgggggtgatccctaagggttagacaccatttagattcagggtgagtacttcacgatatggggaaaggtggcactcctgccagggaaaccttttggaaaatgaataagctctccctaattaaaccaagaatttcttctggtggattttgttagaggagagagaagaatgggatgtgaaacccaacatgaataataccaccacaaatagtttattgtagattcacagatctaagagaaataacaatcaaatgcagtacttggtccatgacagaagcctggtttgggaaaaagagccctaaaagacatttgtgggacaataagagaaaatgtggatgtaaagtgaacattagatattgagaaattattgctgtcttaggtgtgataatgttatggtggttatgcaggagaatggccttgttttgcagcagtgcatgctgagggcttagtgtcacaatgtctgttaattactttaaaatggttcagcacccaaaaaatacatatgtaaccatacatacacatttgc

SEQ ID NO: 137465 - DNA, 1121 bp, Homo sapiens
ctgtcaatggctcccctgtgcctgcagggtaaagacctagccctttagcctgacattcaaagcccttggtgaggctgggcgtggtggttcatgcctgtaatcccaatactttaggaggccgaggggggcagatcacctgacttcaagaccagcctggccaacatggcaaaaccccgtctctactaaatttataaaaattcgccaggcgtggtggcacgtgcctgtaatcccagctactcgggaggctgaagcaggagaatcacttgaaccctggaggtggaggttgcagtgagccgagatcgcaccactgcactccagcctgggtgacagagcgagactacgtctcaaaaaaaaaaaaaaaaaaaaaaaaagactcaaagcccttggtgatgtggcttctgctgaccactccagcttcctacacctccctaaacatgtcccgtcttacttcatctggccaactgtcactgtcttctggatccagctcacttcctccagtgagcctgcccagagttctcgggctgggttaggaccctgtctgggttctcacattctcctttgctcccttctgtcccactagtcacagtgctcatcatgtatttatacatctgcatccatattcctcagtagactacgagctccctaggacagggccaaggtcccactgccctctccaggcagatgctttggataaattagctccttcaaccctcacaacaaccctgtaacatagatgattgtgccccatttatccaatgaggaaaccaagacccagggagaaggtgaccaccctaggttgcctacctgggtggcagagttggcatcagagctgggaatgatctcccagctgccttttctcctacacatcctacatctcccccaccccaaggcagggggcaggctgagtggtagaggtagggggcacccagggaaggggataggaagaagactctggcaagttgtgggcacacaagctcaggcctgtgtaggctgatgggctctgactggaggctttgttacaacgagctctgtctggagatgtctcatgtggagtacagactggcatttccaaggatccagggtgtacagtccctacctgggggctcagtgtggggatttca

SEQ ID NO: 137466 - DNA, 1132 bp, Homo sapiens
taaagaatggctactccataggcagagcagcctgagttgaagaaattgagcttcctgttttgtatcaatcccaaccctatctgaggccccaggatgaacctcacagcttgagcttggccaactgagcttccttaatggagcctcccagattgagctccccacatcaagtccaaagatgaaactttgtccccagaaacaacttaccggtctggttttctgagctgttcagaatgagaatctctgaatgagagcccgcctgagatatgcgcactaagatcctcagcccaagatcgtaagctgagctcccaattttttacacctcagactaaattccccaggctgagcctcactgaatcatatgtctggttccccagactgacttgcccactttctactttccagactgcactctggagcctggaccctagaccaatctccccataccaggccatctggaactcctggcctcagttgcctacactgggcccaagactaaactccaaaccaagatcctagactgccaagcccagaccaggccccactaacgcttccaaaccaagcccctacatcaggccccgcagattgcactccctagcctgaacccctaagtgaaattctagactgaaatccccacactgagcccccaggtagggactgtacaccctggatccttggaaatgccagtctgtactccacatgagacatctccagacagagctcgttgtaacaaagcctccagtcagagcccatcagcctacacaggcctgagcttgtgtgcccacaacttgccagagtcttcttcctatccccttccctgggtgccccctacctctaccactcagcctgccccctgccttggggtgggggagatgtaggatgtgtaggagaaaaggcagctgggagatcattcccagctctgatgccaactctgccacccaggtaggcaacctagggtggtcaccttctccctgggtcttggtttcctcattggataaatggggcacaatcatctatgttacagggttgttgtgagggttgaaggagctaatttatccaaagcatctgcctggagagggcagtgggaccttggccctgtcctagggagctcgtagtctactgaggaatatggatg

SEQ ID NO: 137467 - DNA, 1835 bp, Homo sapiens
aataaacacacagtagaggccgggcgcagtggctcacgcctgtaatcccagcactttgggaggccaggccgggggatcgcctgaggtcaggagtttgagactagcctggccaacatggtgaaaccccgtctctactaaaaatacaaacattagctgggcgtggtggcgggcacctgtaatcccagctacttgggaggctgaggcaggagaattgcttgaacccaggaggtggaggtttgcagtgagccaagattgcatcactacacttcagcctgggcaacagagcgagactccttctcaaaaaaaaaaaaaaaaaaaaaaagagctgggcgtggtggtgggtgcctgtaattccagctactcgggatgccagggcaggagaatcactcgaactcgggaggcagaggttgcattgagctgtgattgagccactgcactccagcctgggtgacagagcgagactccatctcaagaataaataaataagtaaataaatacacagtagaatattagataggtgctgagtataattcagagaattagaagagggtggcatgacagtggctggagagcctacttgagattgggtggcctgtctgactagaagacagtgagtcaaaacctgaataaaaagaaggtaggcacatgcctgttggggttgagcatgttccaggcagaggccacagcaagtatagggtccaaggcaaggggagatattaggggaggtggggtgctggacaggttgcatatctctggatcaggaagaaggtcagtgtgacctgaacatgacaaataagagtagaatggtagaaatgaggttggagagaggagcaaagactgaaggccaagataaggagatggattttattctgagtatggtgggtagccatgggaaggtttcgatcatgattacttggggagcaagagagagagagctgagagatcagttagaagccttttgcaataatccaagtgagaaaagttggcttggatgaggacagtagcagtagaatcggtgagaaatggttggattcaggatacattcttttcagaagcagcactgagaggactagggtggagtggatgctgggcttgggagcaagagtcaggaatgacttaaaggtttttggctggtggtgatggttcctgagatgatcttaggagtctgactttggacatgttcaaagtgagctgctagtcaggcagttagatgaatctagaatttcagggagagatttggatgtcattggcacatagatagtattccaaagccataaggctggccaagatcaccaaagggagtgagtgtaaaaggaggggaaagggggccaaggacaaagctcagggatgtggaatcaccaaaggagacttagaaggagcagccctaggctgggcgcggtgactcacacctgtaatcccagcacttttggaggctgaggcaggtggatcacaaagtcaggagttcgagaccagcctggccaacatggtgaaaccctgtctgtactgaaaatacaaaaattagccaggtatgatggtgcacgcctgtaattccagctagtcaggaggctgaggcagtagaaccacttgaacccgggaggcagaagttgcagtgagccgaggtggcgccactgcactccagcctgggtgacagagcaagaccccatctcaaaaaaaaaaaaaaaaagaaggagcagccctaaaggtaggaagaaaaccaagaaagtgtggggtcctaaaagccataagaatggggttcgaggccgggcgtggtggctcacgcctataatcctagcaatttgggaggctgaggcgggcagatcacctgaggtctggag

SEQ ID NO: 137468 - DNA, 1783 bp, Homo sapiens
accacagaaagccagcatgaagcctggttcctatatctccccacgagtctgtgaaccctgagggctgggaccaggtctggtttgctttgctcctgcaccagactgaccaatgaggagtacaaccaggcctggtctctttgtctcacctaccagatggtgaccctctcagggctcaaatgggtgtgactcatttctgtgtccccagcatcacccagcacacagttgataatcagtatatgaagtggtcctggcagtaaggtctcagggtgagtacttcaaccagtactcgggcagggcagaattgaggcaggtggcatcccaggctgtggtctgaagtcaagccgagcctcttggcctcactggcctgtaatgtaagcagcatttctgaaggagcagactagctgagaagtaggtttctaggactgagatgaaaggtatctgcctggggctggaaacttgtgggggaagtttctgaggggcaaagagcagcaggaccacatcagcccctaattccaccccagggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcaggtaagtggtcaagctggaaggagcagacttggggaggagaggtctgcagggatgtggtggggcatctgcagccagatctgagcccctctgcttctgcctgtcacagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaagtgagtgtgtgcacccaggccccttcctacttctccacactaatagctctaggccagacctctgaggcaggaccccaagacttaattcacagggtcggccttccattgccacatgattgaaatcccagaggagaatctccaaactgaaaggcccacattgaggttctgaagtgagaccccaggatgagatcctccttctgaatgttctctttgggtattcaggcagggacctctaagttgagacccctgcctgaatacctgtagagaacattcagaaggagatccccaacctgaacttcccaactggaaccccagagtttgagtggcatgcccattatgatcccctaaaggaactcatccatttcctagatcgagaccccaaggctgacccctagactcacccccaaatgaagttgtaccaaatgagaaaggaaactgagcctgaaacctcagggactgagccaccaagctgagaggccagactgacccctcaggccaagcccacatcacagaatctccacagctgagctccccagaaagagccctggctcatcaattttccatcctccagatttagagctttcctccatgtccgccagccactacccagaatgaacctcccaaaagaacctccaaattgagcaccctagactggaccccaaattttccacctctcaaatttggatctctaggctgagatacctcctccccagactgaatccttacacattgaaccactagaaaagtcttctatcccgattcctccagtatcaacctgaaccccacaccccagatagagctccccccgcctaccccactttctcttccccagattttcattcattcattcattcattagt

SEQ ID NO: 137469 - DNA, 2144 bp, Homo sapiens
tttatacgttcttatacttttgtgcttttctcacaccccaggtactcagcaagcccttgctgatagtgtactgagtgggtgaataaatgattaattaacatttatataccatttaatctgtagtctgatgtgttttatttatattaaattatctaattgtctccattaccaatggacttcagtcctattattattttgttttggttttgtttttgtttctcaccagcctctacattaaatagattctattattatctgtatttatggatgaggcgtcctaaatacagagctgttaaagaacttacacaagctagtgaatggcagagcttaggatttgaacccaggaagtctgacttaccatcccacatgcttaaccactacactctgctgagtgaatagagagagcgggtgaatgagttgttgagtgagggagtgcacgtcatcagaatggaggggtaggctttatggtagactggggactcagggatgaagctgaaggacttacagatctagagatgggggtcaaggttatcctagggtggtattaggcttagagtggcatgggaactgttttaagaattctgggggcttgggtgagggttacgatagaggatgatggatcaggggttactgtttctcctttccagttgactgtgcagcaaaaggtgtttcacattgccaatgagctcctgcaaactgagaaggcctacgtttccaggctccatctcctggatcaggtgagtggccccttgggggtacgagggccccaggaccttgtaggtgcgtttcaaggaggcagtgatagggcctgagttcaatcccaccattgtggccagaatttagaggcagtaaggctcctctctgaccttgaagtcagcttgtccctgaagccatctctgattatgccccaagcttgatcagtgagggctgataccaaccctcactcctaacgctgggcaggtacaccagccctgactgcgactctgacactagtactgacttggacccagatcctgaatttatccctagctgtgaacttcattctaaccctggccctattccagatcccaaatccactagaatccctgagagtagagatttttatctttgttcactgctctatcttaccctctatgacagtgcctcgcacacagcagacattcaaaaatattcattaaatgaacagatctaattccaactttctctctgaccctgaatctaattctaagcctgaccttgatcctgacttctaattgttccaaagcctaactcttggcagcagggacccctttctgtgcccaagcagcctaacatttcttcagaaggcaccctcgcacttgagttagatctcagccagaatacttgctctgccgggaccaagctcaagtgtgggggccaaagccagggactgctggaataacctgaaatccatctccccaatatataaccctaaccccattccctgtctcctcagtctcaagaccaatgctgatcccaaagctccacaagcctccccacaaatactgccctcacccttcaccagccaagccccaggcccagctgggctgagtgcttctgccctgccccacaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatggtgaggggccctagacctagactgcccactcccctgtccacctgcctgccgagcccagacccagaggtgtacacaagacttcatttctgcttgctcttcctcttagtgacttttgaaaaaggaatcagagccgggcacggtggctcacacctgtaatcccagcactttgggaagctgaggcaggtgaatcacctgaggtcaggagttcgagaacagcctggccaacatggcgaaaccctgcctctactaaaaacattaaaaattatcctggcgtgatggcacgcgcctgtagtcccagctactcgggaggctgaggcacaagaatcgcttgaacccaggaggcggaggtgtggtgacccgaaattgcaccattgcactccagcccaggtgatagagctagactc

SEQ ID NO: 137470 - DNA, 1430 bp, Homo sapiens
ctcagcctcccgagtagctgggattacaggcatccaccaccacacccagctaatttttgtatttttgtagagacagagttttgccatgttggtcaggctggtctcgaactactgacctcaagtgaaccgcccgccttggcctcccaaagtgctgggatcacaggcgtcagccaccgcacctgacccttcctgtatactttaaatcatcgccagattacttataatacctaatacaatgtaaatgctatgtaaatagttgttatactgtactgggttttatttatataatttttattgttgtattgttattttttgtctttttttccaaacatttcgatcaatcagcctccatgcagaggccgaggatgcaaaacccatgaatgtggagggccacctgtatgccacatgtctgtgattgtgagttcgtgtttctgagtgtgtggtatcatgtgactttatgctgttttgccactgtatgtgattgtgtctgacatggtataattgactctgtgcctatagtctttgtgtgtaaccatgtttgcaggtgtgacatggtgtgtatgacactccatggccctgcaattgtgagacatagtgtaaatgacaatgtatatcttttgtgactcagtgaaaccatgtttgaagaatgtctaactgggtatatgattgtctgtggttgggcggttgtatgaagctgtgtgtgagatggcagaattgccattgtgtgactctgtgtctttgtgactgcatgaccatgtttgcaggtgtgtgtgatactgcgaggctgtgtgatcgtgtgtgaggttgtggccgcaggtctttgtgactgtgtgtaactaggctttcaggagggcgattacctgcagttgggtgaaatggtgtaaataacaccaagtgtttctatgactgagtgggcccatttgtgactagtcatttatgagactgtgtgtgatataagctaacagaccctttgtggctgtgagtgggaggccatgtggttgtggcacagcataacttacaccatgtgatggtggtacctccgggagctcttgactactgctcactctcttgtcctcacacctgtttgcctccatctctccctatgcaaggggtttttgtggctcccttctgctacaggatgaatgtcagcctagcatccaaggcctttcccactcctctctggccccacctgacttctctatcatttgaggcactcccacagccccctgcccagccaggaccacatgagccccacattcctttccttggggcatgccatccctggggtgggggtccctcactgcctcccagaccaaatcctctctcctaagcatgaccatcatctcctctagagccaaagatagaggtggctttaggggacatacagtgagggaagagggacagtataaaaaggcctcccctttttctga

SEQ ID NO: 137471 - DNA, 3350 bp, Homo sapiens
gagtggccgggcatggtggcttacgcctgtaatcacagcaccttgggaggctgaggcaggtggatcacctgaggtcgggagatcgagaccagcctggctaacatggtgaaaccccatctctacaaaaatacaaaaattagctgggcttggtggcaggcacctgtaatctcagctattcgggaagctgaggcaggagaattgcttgaacccaggagtcggaggttgcagtgagctgagatcgcaccattgtactccagcctaggtaacaagagcgaaagtccatctcaaaaaaaaaaaaattaactgagtgtcctgtattttatctggccaccctatccattctcctccactgagcttccccagtccccacaggctcgccctcgttgcctttcctgagttagagtctttgtctttgagattgggagctccctgagggtaagggtcaagattgcccttctggcctgctgaatgcctgggggggcaggggtttgagagtggggcaggaagggtgcataccccacccccatccccacagcagagctggcacagtgcactggcactcctggggtgcctagagtatgctttcctaggtgacaagagatgtccgagtggcagtggtggttgtgtgtgtgcagttgtgccgagcacggtgcacacagacatgagtagctctgtggttctctctctgggtctttgagggatgtgcacagttggtgtgtggctgggtacatttccacaaagtgttatcagatttggtggtggctgggtgtggtggtacacacctgtagtcccagctacttgggaggctgagacaggaggattgcttgagcccaggaattcgacaccagcctgggcaaaatagtaaggcctcacctcaaaaataaaaaataagaaagatttggtggtgtgaccaaatgtgtgtgacgggggctttttggtgatctctgctctactgggcattggggaattataaatccgttgatggaaggggcagtgctggtggaggatcttgtcaggtgtggaggtgtgggtgtgggtgtgataatgttgtggattatcaaccacaagaaaaatgggctggaattgggcacactggctcatgcctgtaatctcagcacttttggaggcagaggcaggaggatctcttgaagccaggagtttgacaccagcctgggcaacaaagaaggaccccatctctacaaaaaaaattaaaaatagccagccatggtagtgagtacctgtagtcccagctacttgggaggctgagatgggaggatcacttgagcccaggaatttgaggttacagtgacctgatcacactactgtacttaaccctaagcaacagagcaataccctgtcttaaaaaaaaaaaaaagggctggagaaaatgaatccaggaccttgctgggtagggacgggatggggcagtgggaatggctgtggtttctaggaaggaggaggggggcctaccctgggagctccccaagggcagggatgggattttctcatctccaagcacagggtctactaggttcaaaaatattctggagaccaaactcagccaaggaaagccatagagttcagcatggtcatgaggggccactgagagctagctgagaagtttctttttttggtgtttttgtttgtttgtttgtttgtttgtttttgagacagagtttcgctcttgttgcccaggctggagtgcaatggtgcgatctcagcttaccacaacctccgtctcctgggttcaagcgattctcctgcctcagcctcccggtagctggtattacaggcatgcgccaccacgcccagctaattttgtatttttagtagagatcgggtttctccatgttggtcaggctggtctcgaactcccaacctcaggtgatccacccacctcagcctcccaaagtattggaataaaggcgtgagccaccgcgcccggcctagctgagaagtttctattttcccatggacagtagggagttacagaaggttcttgtgcaggtaagtggcatgatctgagctggactgtacgtaagttcattcagccacctggagggagcaagacttggagccaaggaggccactgagggaaaataggagacagggaaatgtaggcagagagacaagggagagggagttctgaaacgagagggagggatcttgaaccttctcccgctcagtgaaacctagcctggttcttggccaggcctaggctcctaaactggacccctgttcaactccctgtggacagggttgaggggtgtccctctgactagctacactgcagtttgtgactttcggaagccgttgggtccacccgcccctcctggttcccctcttttccagcttgcccttggagagcagggttaataagaaaggaatccagtccatgaccagtctgcccaaaagtgtgccattcattgatttgctctgtgaccttgggcaagtcactgcctctctctctgactccatctcctcactagaaactgggctgacaatctcttttcctctcacctgggactccagggaatctttgcatttcattcagcctcctcttcctgcagggctgcctgcaaggaggcagagagaatggagaggcaggtctgtctgtgggctgtcaggtgagatgggtgaggagggagcaatgggtgggctagggcagggccatggaaagtgggatgtatggtcactccatcccgaggaccagcactggaggagaaggagagcagcattatccagggaccctgctgctttgctacagatagggtagggagggcttgcccagagaggcctgcctgctttgaggtgtggagataggtgggctcctccaggcccaaggaggcagacaaggggcaccagggaccctggcacctatgtgtgtatatctgaggaggggtctctgcatggcagggtgcctggctttactcactgcctctctggccctgtcagctcctctctgtctctctcccttgctctggccatgtgtctctccaaccacatctccgcctgtgccaccctccaggtgattcatcttcctcacccccacgcccagggggagggcagggcaagaccaggccaggatgtgctgagcagggcagggtaagcggcacagctgagtggagaggagcgcctcctccatcctggccaggccctgccagcttaggtggggaaggaagtgaggaacgacacccaaagcaaggtacagagttggggaggggcgctcggcctggggcctggggcaccctgttccctcagtgctgggaaaggaccctgatctgagtcccctggggtggacctggctgggatgtagccaggggtgaggtcaggggcctagggaagctgct

SEQ ID NO: 137472 - DNA, 1595 bp, Homo sapiens
aaaacctggatttcccggccgggcacagtggctcatgcctgtaatcccagcattttgggaggccgaggcgggtgaatcacctgaggtcaggagttcaagaccagcctggccaacgtggtgaaacctcgtttctactaaaaatccaaaaattaggcagatgtagtggcgtgtgcctgtaatcccagctactcgggaggctgaggctggagaatcgcttgaactcgggagacagaggtagcactgagctgagattgcgccactgcactccagcctgggcgacagagtaacactctgtctaaaaaaaaaaaaagaagaaaaatctggatttctggattcccttgaaatattggaagacctgacaatacagcgccacattactgcaagatgacacctgggtggaggggagaagctgctgcttctacttcaggttaggcatgtgctttccagtttaacccagtccccaccattccccatggccttagactgtcccactctacagaaagttcctcactttatactagggtctgcactttacagaaacatccttctctttacagaaggggcctcactttacaaaaaggagttctcctttttaacagtcttctgttttgtcatgatccttaagagtcctttggttacaaacaggccatccattttacaaaagggcctttagagaactctcctcactttacagcatgtccctccactttgaagaaggctcctctttttggaaaaacttcttccctttacagaagggccttctgtttatcaaagagatctccatttcacagaaagtgtctccgttttgaaggatggaacactcttcaggaaactcgaaagagttaggaagctcctgacttgccagaatggcccccacttcttgaaagtgtcttcacactatagaaagtgcctccatttttctgcagagtccttatgttgagaagaatagtcgacttcagggaaggaacccctgagctacccacagggttcctgtaaacagctccttctgcacatttcacacttgaccgagctttgtgtttgaactttgagagacaacatctgccaggtcaggcagcctgggtgcagtctggccttgaaggcggagtggggcagctggcctgcagttcacattcaaggggcaggtgggaagaggtggggcagttatggctttttttttttttttttttgtcaagcggagggatgccccttcccctgacagaactggcttcccaaaaggcactttcctttctgctgttcttctccactccctctgctccctttccccaccccacccccaggaattccagctgtcccaggagcctacctctctgcccggaaaggaaaagatttgagggctgtagggagaagtttgcctgggctgtcaggagacctgcgtgctaggggctggcttctgctcaccctaggatctcgctgattgctcacaacaagcagaacacacgttttctccccattttagcatctctgcagagctatccttcatagctgtgggccccaaatggggaaattggggcccagagctttgaagccacttgccccaggacaccagggagttaatggccaagggccagtctggg

SEQ ID NO: 137473 - DNA, 1093 bp, Homo sapiens
tagcggctttgcctcacaggaaggggaatctcagccagcgtggcagccccagcatctggtaattactgctcccagtgctcccagctgcagttccactcccttcccttcctgtcctctgaagtccccagctcctcccggggcgggggagggagatgggcgggggtggagctaccgccccctatcctctggcctctagtccagagaagcagggaggaggtggccaggccctcacagtaatcaaggaactggaagagggatgggctgcttgtgctctcatgtggctgcttggtttgtctgtgtgtgtgtgtgtgtgtgtgtgtgtgtgtgcgcgcgtgtgcgcgcgcatgtgcctggccttctttgtccccgtggatctattttgtgtgtgtgtcttaatgttcttgtttctgtatggccatctgtatgtttgcatatagatccatgtgtgtctctgggtctgtatgtgttacgtgctcctctgtgcctggttgtatgtcaccttggccctaagtatgtgggagtttctagatgtttctgcgcatgggtctccttagatcttgtggatgtgtctgtctgtttctatacctgtgtctgttcccgtgcctgcgtctgcctctgcatgccccctataggtctatggttgtggtgtagggaagggggtgtctgcttgcttgtatcttttggcctttcctgatccttcttcctgctgtggagccttcttgcaaacccatgacattacgtacttcaaatatatgcttcactcatacctccccacccaatatccacacttttgcccactcttcttcccttgtctgcagaaccattctcagtccatctatacctaaaaaaaacacaccccatcctggatggtgcaactaaaaaccacctcctttaggaagtcttctctcctcccccctccaaatgtgatttctttcccaactcagcagtcactgaaggtgtgctctgtgactctggacacagacacacctgggatctggtcccagctcaaccacttttagctgtcctcaggcaaattattttgcctctttgtgcatcagtttcctcatctgtaaaatgggtaatagctcaccgg

SEQ ID NO: 137474 - DNA, 1051 bp, Homo sapiens
gatgtgctgaggctgaggagcctgaagacaggacatctaggtgacagcacccagttggcatcagatatgcctatctgggtcccagagtaagggcaggtgggtgaggggcacaggtatgtagctgagactaagagggaagagccctccttggcgcttccccatggcccctgcagggaaagggttaaatcgcggagggaaggcgcctgtggaaagcgggaaaggcgggactggcagggctggcctttgggagctgcagctggcatagaagcccttccgcccgccagggcctgctaggcctgggccgccaccgcccacaccaccgcctttgccttcgcctttgcctttgccttccctgctccccctccagccccttccctgctcccctaggctgggggacccccctacctaatgcattccaggtgtagacgcagcccctcccccaccgcgcgggtgtgggaggggcagggaaggctggggtcactttcaccgcatctcttagggagcatctcccaggcttgctgactgcttctctctctctggagaattccctcagggatctctgtttgggcctccctgactctggcaggggctggcagcagagagagccccccagacccaggtccgccactttctaaagtgtcacgtgaccttgggcaagtcatctcacccctctgagcctcggttttctcatctggaaaatggggctgtcattcccaccttctagggttgttgtaaggattcaatgccacagatccatccccagcccttggcatggcacattgtcaccatgttcaacagatggccctggcctgccctttttgttcctgcccctctgcctgggtctgtatccctcgctgactaccatgccctgtgtggacctttctgtctctgtctcccttctgacttgtcccttccttttgtccatctccctctatgtccatctctgggtctctgtggttttcctgtcctctccctccttgtgtttgtcccagtgtctttctcttatcatctgtcttttcccctcataatccttctgtgtctccaactctca

SEQ ID NO: 137475 - DNA, 1711 bp, Homo sapiens
gctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctggtgagtgagcgactgagagagcatgggagcccgggccacgggcctggtactgggagcgggttcttgttctcgagccctctaagccccacctcggaacaggctcgcttacctcggccctttgggttccctcaaacccctcctcctccccacgtcccttggccttatgtccagtcctttcaacctctgtccccatctcctctctctgtcccttgtgcccctcaacctctccaacccccttctcctctgtctgctgaggctaatgggagagggagcactcgcgagaaaaagagggaggattgcaaggcagcaatccttggatatttggttggggaaaccagggtttcgtttggagaacagaagaaaaaaaggagccttacatttgccaagcgcctacattgtaccaggcactggactgggtgctttacatggattttcatttcagcttcaggaaccctcatgaagtagataccattagtcccattttgtagggaaggaaactgaagctcagagaagttaagcaacttgcccaaggtcacacagctagtatggagccacgattcaaaccagatctgtttgtgtccaaagtctgtggtctttctgcttccccaaactgaggctggagaccatgaaagtaatgccaagccttctgcttatgtgattttctcctgtactattcagcagccctggagtatgagcggaaaaaaaaaaaaaaaaaaaaaaaaagaaagacggtggattgatccaaggttgagattttgccaggtgtgtgtggcgggagaacaagggaaggaaggagtagaaggtgctgagagagaaaggtggaagaggtgggccttgggagtcaggctagaggagaaggctggaggggctgataggtagggagacagcagaaaagccaacagaggcagaagccagttgtagcaggagctggagagctgcaggtccacgaggttggttgtgatgtgaaatcaggatggtttcttggatttgaaaaggtggagcagctttaagtcaggctgaggccacagaccactgcctttgtgctacacagacctgagtgtctgaggagcacagcaggaccttccccatctggggacattctcatacgggcctgagcccaggagccacagaagaagagcagcgcacatctgccctgccttccactgggactgaaggagttgttaagcccttgggggctcccgggttcacacctcaggctccacagatctctgggaccgtggccttgcaccaggtagcagtagtgaagtataa

SEQ ID NO: 137476 - DNA, 1040 bp, Homo sapiens
ccgggaaggtggttgggaatagctaaccaattcacttcaggtggggaaatactcggccagacacgtgacccaggcggccattttctcacaccctgctgtcgccatcttccaggcagacaaagacaccatcccccacccttgtctgattcgggcgtggtgactgcctggttattgagatttgggagcacgcatatttaaccccagacagatgcccgcagacaaaattttggcttgcaagtaaggtatatggccgcaccagtcgacccgccgcttcttcccggtcatttccccgtcctccttctccctcctccgctatttccttaactacggggcaggcaggaggcggggccagcgtggtcgcgaagaagggacgggcgggcgtgagctgtcagtcagaagctccgcccccccccccccccccccgcggagaccgcacggtgggcggagtcgggcgccgccggcctgggatccggaagtcggagcctagctgcgcgagagtttctgctcgctcaaccgagttgtcgtgttgccctcgcttctcagatccccgccggaagtgtaagtaagaaacttctctcctcttttctcacaatgtgcgctcacctagacggccgggcagttaggatcgtctattggatgtgaaaccagagatgcccgccaacctggaatagagaggtaaacagcaggatcccttccagggtagaagggaccggaagaggggcagggatcgcggcacacgtggagacgcgccgaattgccttttcgcggagtggagtttgccgggagaggggcattgccccatcccacctagaaaggtgtagacccgggacacactgtgtagagaggcacaaacttcacttgtgtggtgaagcgttgatcgtcctcaagatagtgaggcttcattctgcattcaccttgtatagacaggagtcgacccaccaaaggcatgggggacatccaccccaaccgtgtagagacatctccctccacccagctgagcagcgcagacttctcccgacttaaggcacttccttggcttg

SEQ ID NO: 137477 - DNA, 1049 bp, Homo sapiens
gatatgcaggtctccctccctgtaatgttgagagggagtgacatcgctgattacctggcagttcagtgcgtatggtctctcccctttacccaaggtagtggagctcagatctgtttctctccacccagggtagaatcacagacgcccccacccccaagtattagggctgatctattaatttatagctgcattgccagccccctccacacaccacccatgcagagaaccagagcccctatttctttcagtgttagtgtgccgctgacttcaaccagcataaaagatgaaagttgtcacagtccaccttccatagaagggtccagaatagctcactgcaggtaaggtgcagacccgcttattcaaagctgcatagttgtggaatcaggcatatcgatcctgtaccacagccctctccagggtgaagagacgcaggacccatccccacaatctagagataaacagatctgtgattctttccccatgcagcagagatgcacacagccactttgtgggtttccccagtttctctgcaccccagagtagagggacagatggcaatccccccaacccaaatcaccaaggtatagaccccaggcatatgcaggcacagatttttaccccctcctccaagattttgtacttatctcaatccatatagacactcaggtaagaatccctgttctcaggccccttttccccagggtagactcctgagatctatttacgcccttccccaccacctctcccagggtagatgagatatagaatcccctacttgggaaaagaggcactattatcaccccatatagaaatagaccatccttgcatgtccctttcccctcagtgtggaggtgttgagcactagtcccctacctagaatataacactacagtgtggaggaataaggaccaaagaccccatctgaccccatttgaccccactgggctcaaagcccagtggctttgagccactgactccaccccggatgaggttgagacctattcctccctttgggtagtatgacactgccttctctgtgtggactcagc

SEQ ID NO: 137478 - DNA, 1870 bp, Homo sapiens
agtgaaaacaacaaccaccttttgagaggcctgcaagtgaagcattgtccttgggagagccaagtatcaaggcaggagcttggacaattgatcccagggagaggttgttaggggagtgctgatcacccaggtgggagtttcagagaatgttgtgggaaatttgatgctacggcagaggaaggatgaggggaatgaagtcagtgggtgtacagggacatctgtgggtgacagtatgggagatgagggattagcgaatacagagatctgcttttgagtactgatgaattggtgattttaggcctagatgatattggtggatgcattgaggctcagagaggttttaaaaaattcttcaaggtcatatagctaggtagttgttgagccagagtaagaatgtctgctggttataaaatggtagctgttttctctctggagttgttgaaaaacctatgagcagaggctcctgagtgctgggagggatgactgactgcacccccttctcctttttccctccccccttctcttctcccctctgaagcacattctttttctctccaagtgatgtgttttctttcactgtgtgcttgtatccattgcaggcactcagtttccagggaagttaggcagatggaaattgttgagtgaaatgtccagacctggttcattccaaacctcacattttttttgttgttgttgttgcaacatgagtactttagaagaaaggagactggtggtctgtttcgtgtttatttaaactgtgtttatttaaattcgacccattcacatttgttatgagacgtttatgtctggtcagatttctaccgtcttattttttatttatttattttttgagatgcagtctcgccctgtcacccgggctggagtgcaatggcgcgatctcagctcactgcaacctccgcctcctgggttcaagcgattctcttgcctcagcctcccgagtagttgggattacaggtgcctgccaccatgcccagctaatttttgtatttttagtggagacagggtttcaccatgttggccaggctggtctcgaactcctgacctagtgatccgcccacctcagcctcccaaagtgctgggattacaggtgtgagccaccgtgcacggctctctaccatcttattttatatttattatttattttgtttcctcttattcccttatttatgttttgctaacttgatgaagtttttaaacaatcctccatcggtaattaagttatgttggtaattgtattcatatttatatcaaacataattaattctgtatttatcactttaccaaagttaaataatgactattttgtaacctaccctttcaaaatgaaacctttagcatgctttcatgcttttgcttttccaacccccattacttgattcctggattttattgaaataatttggtatttcagttctgagctatttccttatgatatgcttcttcgattttaagaatcctttttttgttgtttttttgagacagggtctcactctgtcggccaggctagagtgcaggtgtgatcatggctcaccacaacctccgcctcctgggctcaagtgatcttcctgcctcagcctcctgagtagctgggacaacaaacatgtgccatcacacctggctaatttttttttttttttgagacaagagtcttgctgtgttgcccaggctggagtgcagtggtgcgatcttggctcactgcaacctccacctcctgggttcaagcaattttcctgcctcagcctctcgagtagctgggattacaggtgcgtgccaacacgcccggctaatttttgtatttttagtagagacggggtttcaccatgttgggcaggctggtctcaaactcctg

SEQ ID NO: 137479 - DNA, 1010 bp, Homo sapiens
ggcagcattttggctgagtaggtcaagtccctttggaggcaatggcctgagcagggtcagcaggaaggatggttctttccccacatactgagggcatctgcccaggtttagtgggctgggactccttagattaccttctcattctgccagctccctcatctcagcctggcacttaaattgttgagtttcccccagtaggaagttctgggggaaagaggagtcacaagcacatattcaggtttctctctgtacagaattcctctcagaattatttgagtttgcagtgaaataatgtgcaaatattatatccagtacttcctctgatactattgctgccatccgcatctcttgtcttgtgctggatctagacagacatggtatctgaggcttcctagctaggttcccagtgtggcctggccttgattcagatgtcaacaaatatcgtgtagatggatgacggctcttttctttcttttttttcttttgtagaaaataaaaagccaggtgaaggttccaagggccacaagaagataagttggccctaccctcaggtaaggtatgcctgttgttgagggtaaggtcaagaacaggttgcttgtcctgggagaggcccactaaacccagtaaatattgggtgactctggacagagtgccacattggagtcagtggatctggctttccctccttctctgggtggccgcagcagagaatcagcagcatttttcccaagtcatatgcagcttcgtgcttgatttaccttggtagggattatcattatccccatgttttagttgaggaaactgtcagtgagaaagttcctaggttcaaggtaacgcaactgggatttgagactgtctgattctcaagtccctgtttcttatggagaagagggaggccaaaacatcatctttggttcctggatctcctggtcctgctgggaaaggtgtgggtaagtaaggcttgggaaagagcaatgagaagaaggtataggccagagaaggcttgggtt

SEQ ID NO: 137480 - DNA, 1054 bp, Homo sapiens
tagtagagatggagtttcaccatgttggtcaggctggtcttgaactcctgacctcaggtgatccacctgccttggcctcccaaagtgttgagattacaggcgtgagccaccctgcccagccttcttccttatctttaaatgatgaagcatcccaggaccttggcttctttccatctctggtcttaagtggttccgcctgcctaggatacattctctctctgctttttataccctcttttctctgcaactctttccttcccttcatctctctttttcttcttctcaaaccctcatctcctgatgtcatatcttccctctccctggaccctgctcctgccacctctgccatgtcgcaccatttcctctgtctgtcacccatccctcccttaggctgcagacccagtcagctccagtaccagtgtgtgttcacttgttaggttgaggagatgagggagaagcagcaagccgcccgggagcaagaaagacaaaaacgcaggaccattgagagctactgtcaggatgtcctaagacgccaggaggagtttgagcataaggtaagagtgcagcccttgcccctgggtaggtttgctcaaagcatcttttgccgtttttctgtgaaagggaagaaggtgtgaagttgttggaggggaacaagggaatcagtgtagagaggatagaaaaccatggggacggacgaagggagggagggagggataaagggagataaagggccattttgagccttacccgtgactggacacctctggagagctcctctctcccaaggttgagcctgaagactggggctggtggcggagttgggggctgggagagttacatgtgaccaggggatggggttgggggagagggagcgaaagtatgaggagaggattgagagacagagaggagcatatgtgaggggatgttgtcttccttctagggcttcttgctgcctttttggcagatgttcttgtttcacacacagaatacacgcttgccagctcatactcccttttctgatatgcagtgtgtatgcctcccccatcctgtgtcc

SEQ ID NO: 137481 - DNA, 1046 bp, Homo sapiens
ccattgtgtatatgtgccacattttcttaatccagtctatcattgttggacatttgggttggttccaagtctttgctattgtgaatagtgccgcaataaacatacgtgtgcatgtgtctttatagtaacatgatttataatcctttgggtatatacccagtaatggggtggctgggtcaaatgatatttctagttctagatccttgaggaatcgccacactgtcttccacaatggttgaactagtttccagtcccaccaacagtgtaaaagtgttcctatttcttcacatcctctccagcacctgttgtttcctgactttttaatgatcgccattctaactggtttgagatggtatttcattgtggttttgatttgcatttctctgatggccaggactcacatgattttttaagcctcctatagtttaaaaagccctgcttctctttctcgctctctccccctcctcccctggaccattctctttttttttctcctttaggaggaagttttgcaggaattaaatatgtttcctcagctggatgacgaggccacgaggaaggcttattacaaggagttccgtaaggtacagggttccatttcttcaggcttttgcgggagggttccagtccagccccttttcctctccatttctgttttttcctgactgagatggagatttttgtttcacaggcctgcatcactgctaccctatccttttcctgccctcatctcctggtcctctgccctgcaggtggtggaatactctgatgtgattctggaagtcctggatgccagagacccattaggctgccgctgcttccaaatggaggaggctgtcctgcgagcacaaggcaacaagaagctggtcctggtcttgaacaagattggtgggtgttaggcaggattgggtgtgacagggaaggtgggcaggccatctttaacgtctagcttggaccagacactgaacccagcaactcagtgatactcataatagtcatgcaaagtagaaatttttgttccgattttcaaagcctgtatcacagag

SEQ ID NO: 137482 - DNA, 2218 bp, Homo sapiens
cccacattcgtgtgggtgttgtgggtaagacctgctgtgtggtcatggggctcaggcttctttcttgagcggacacttcgctgggggaaaggatcctgggagcttcattgtcttttgcggggagagaggagtggttcaggagaagggtttcgtgatttgtaacttggatgggtgggcatcactgcgtattgagtattagattcatggagcaaatacagggtgccaggcttggacttggtaccatctcatcctatcagagctatgggaggatggggtgaccgtctaccttttacggatgagaattctgagtgaggctcagagaagggcaaagggacttttggagcccagccctgtgcaagacaaggcagagctgaggatcaaaacctgggcctttctggagcacaagtttctgagggagggatgatgggaatggagtagggaaattgagagaggcagagatagatcaccagagaaagaatgtgaagccacgtgagaaagacattggagagagagctagacactgagaaggtataggtatgcataccaggatagatacagaagaagacacagagaacgcactgggaagccagatggcaggattggtggggaatggaaagaggagacagatttacatgatggaggcatgtaaagagggagatacaatcagaaacaccaaaagggacatagaaacagacatgcatacagagatctgccgagggagacataggaagggtagagataacccatgtatgtagagaggcagacatgttttctcaaagaatgagagagaaaaacatactacagggatagagacagattcagagagagacatacatggaagcagactggacaaggctgtagatacagaggaacacatacacatagctcttaagtacacatacagatccacaaacacatacacagacccacgctacagacccagagatccagaggaggcacatctagcgagacagaaccacagtcaaaatgcatgtagaccaagcccttcccacacacacccaccccaacgctgctcccccaacgcgcatagaaccacaaggagggctggatgtagcagctcattcatgcctgtagccccagcactttgggaggctgaggcgcacagatcacttgaggtcaggagtttgagaccagcatggccaacatggcgaaaccccatgtctactaaaaatacaaaaattagatgtgtgtggtggcgggcatttgtaatcccaggtactcgggaggccgaggcaggagaatcgcttaaatctgggaggtggaggttacagtgagttgaggttacagtgagttgagatcgtgccactgttgagatccagcctgggcaacagagcgagactccgtctcaaaaaaaagaagacacgcatgtgcccacatacactttgaccctcgaacataatcacatacctagagttacagagggacacaaataccagacatgtcactatgaggcaggtatgtgtacctgtacagagagaaatagagacatacagagaggaggttaaggaggcgcagacagggagagagtagaagagacaccgtgagacacatacagagaggcatccatgaagtgaccagcccacagagatgaggagcatggacagaggctgacaggagttggcatggagggaattacaaatagaggcaggattggtggggtggagagaatcagagagaaaagaacaatggccagaatgagagacagacaaattggcagagaaagaggtgcttagatacagagacacagagagaaacaaagataagatagagaaagagactgagtgggagagatacaagaaaaggaaaaagtggtgatactgagaatgggaatgaccgagagagagagagagagagagagagagagatgtgtagagacttccatgcatggtgataatttagaatgagaatgacctagagagagggaggggggagagaggtgtgcagaggcttcatgcacgagaggtatacttagacatataccttttttttctttaggcaatcagctttctcgggttgaaacaagcatatgcttgagacaatagtacacacatgtaaattgagcacatacagaaagagaacggtgagaatgaggcccagtgaggggaaacacaaagacatccacaggctgagaatggctgacagatgcacaaacagcaaaatacacacctcaggtagacagctgcacagagagactggc

SEQ ID NO: 137483 - DNA, 1024 bp, Homo sapiens
cagaccactgagcactttctgacggcagtggcccaccgtttggggaagaagaagaagggaggcttatatagtcaggaacaggcggccaaagctgtcctagctgactgggtgaggtgaggagggggttaggggtaagggtgaggcccgctggcagcctggctccccaaaggggctcatctgtgctcattgccgctggggcagcttgacttcctgggtcttggggcagaggatggccaaggtgccaggtcatgtcctgctcgagactttatgcccagtgattatccagcaactcaactccttcttgttcagaagccactgtctgggttttcttgttccgttgctgtttctggcctgcaaactcatcgtctcttggattgtcattggttctctcagtgacagcaccactcatctcccctatctcccaatgcagcgggaagatcagcttctatataccaccaccagccactcacactctgcccacccatctcagtgctgagatcgttaaggaaatgaccgaggtctttgacatcgaggatactgagcaggccaatgaagacaccatggaatgtaagtgtgggcagggtgggtgcacttggtcttgcactagtggggccacacagacctgacagcaaatcccacttttgacctcccgcttccttggccctacttgggctttgggcaagttgcttaagcagcttcaggcctaatttcttttcttgcaaggtggggaattctaatctggccctggcagggcgggttgggggagggtggttgtgagcttttggtaaataacgaaagaaaaagtgcctggtacccattgaggtgctctggaaatgtgaagctccattcctgtctcttgggacctggaatggactgagacattctctcaaaaactctctaatgttgccttaggctttttcacaaccacttcaggtccacttctcgattttccttcttacccctatcggtgagtaaggtacccaagtcacagaaagctgatatttgccaaaaggatgtcagcaga

SEQ ID NO: 137484 - DNA, 1169 bp, Homo sapiens
agcccagtgtgaagagggcttgtggaattcccattttccacatgaggaagctgaagctctgagtccagctcccagcaagtgaatgtcctactgcaaaacccatgcttttaattcttggtgatgtggcctctcagcaggagtgaaaaagttcctgcacctgactcccctgggaagcatccatgtatccttttcactgaggcctgaccagggggctggcaacagaggggagccagggccctgacagtggtgttggttgtgttaaaggcttggccaccggagaatctgatgagctgttgggtgacacggacccacttgaaatggagatcaagttgctccattctccgatgacgaaaatagcagatgccattgaaaataaaaccaccgtgtataaggtacctgtcatctttgttcatggcaaccctcttctctccccagggctctgggaagtggtcaatcccttttacctgcctttcatgtggtgagatgtgggtagttcactcgctccctatgggcttctggatgcctggcctagtatatcctttaccaagcaatgacaggtccaggaaacaggcatgctctctaaggcagctttcccagctctggttctagcccatagaacaggtatcactatctagccacccagttgtccaacttgcaaacgactctttcttctccctaactagtaccaggattttattttattttattttttatttttttatttttttttgagatagagtctcactctgtcacccaggctgcagtgcagtggcgtgatcttggctcactgcagcctttgcctcccaggttcacatgattctcctgcctcagcctcccagttagctggaattacaggcatgcgccacgacacccggcttaatttttgtgtttttagtagagacagggttttgctatgttggccaggctggtctcgaacccctgacctcgggtgatctgcctgcctcggccttccaaagtgctaggattacaggcatgagccaccatgcctggcctgggatcttatactctgtcagtcagcaagacctatgtcttctccctcctaaatcttttgacaagcttttcatccttttcatccctaccattcctgttaccctaaactaagcttccagccctcacttacttggacatatgtcccaaggtttctttct

SEQ ID NO: 137485 - DNA, 1146 bp, Homo sapiens
gaaggcctcctggaggaggtgaagtctggggggcatcctgaggaacaacagggtgtgtctgggggatgggaggtgtgcgtggtgaacgttcaggcttatggcgaacatacagccgtgttgccctttgctgtgagagctttgttttgagggtaatggtagagcactaagtttgacatagtaaaagaaaattattgctttggtatttggacaaaaatacttggagcccagtgagtctgaaaccctgagatagaagctgtgttgggatgatcatttcacagatagaaaaatggattgtctacctgtgaagctgagcagtggcttccagcactcaccagttttgtggtagcgtttgggggtaagtgagccagttcaggagcttggtgtagaccaaggtagatgtaggccagcgtcagcaggcctcctggtggcaagccagccaccaaaagattgcctgtatttctccatttgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctaggtgctgtggctcacgtctgtaatcccagcactttgggaggccgaggtgggcagatcacctgaggtcaggagttcgagaccagcctggccaacatggtgaaaccccgtctctactaaaaatacaaaaaaatttagccgtgcttagtggcacctataatcccagctacttgggaggctgaggcaggagaatcgcctgaacctgggagactaaggcaggagaatcgcctgaacctgggaggcagaggttgcagtgagcccagacggcaccattgcactctagcctgggcaacaacacgaaactccgtcccaaaaaaaaaaaaaaaaaaaaaatcccaaggggctgcagctgccaaacccaataccctctatttaacccctactctgttttacaagagaaataaaagaagtatcagcagagctcaggtgctaac

SEQ ID NO: 137486 - DNA, 1237 bp, Homo sapiens
cctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgctctccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcagtcactggtttttttcttcgttctcttttttttttttttttttttgagacagagtctagctctgttgtccaggctggagtggtgcagtggcgtgatctcggttcactgcaacctccgcctccagggttcaagcggttctcctgcctcagcctcccgagtagctgggattatgggcgcccgccaccacgcccagctaatttttgtatttttagtagagatggggtttcactgttttggccaggctggtctcgaactcctgacctcatgatcctcctgcctcagcctcccaaagtgctgggattacaagagtgagccactgcgcctggcctttttctttgttcttatatttttgtcttttttttttttttttttttgaaacaga

SEQ ID NO: 137487 - DNA, 1093 bp, Homo sapiens
ggagtgcagtggcgtgatcttggctcactgcaacctccacctcctgggttcaagcgattctcctgccttagcctcccgagtaacagggactacaggtgcccaccaccatgctgggctaatttttgtatttttagtagaggcgggggtttctccacactggccaggctggtcttgaacttctgacctcaaaagatccacccacctcggcctcccaaagtgctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaacatttgtatgcaacattttgtgttttcatttatctatagtaaatacctagagttggattgctgggatatatggtaagcatatgtttgacattttaagaaacttctaaactgtttttcaaagtggctctaccatttcacattcccatcagtatgaaagtttcatttccacatcctctctagtacttgggggtgtcagtttagttttttaatttttaaattttttaatttttttaatacatttaaatagagatggggtctcactgtgttgaccaggatggtcttgaactgctggcctcaagtaatcctcccatctcggtctcccaaagtgctaggattacaggtgtgagccaccatgcccagccaggttttttgacattaagtatgtggtggtatctcatcgtttttatttgcatcctctaatgatttgagcatattttatatgcttatttgctatctacatatcttctttggcaaggtgttcacatctcttgcatattttggattgttttattatttttgaattttgaggattatatgctggatacaggggtgtttttttttttttttttttttgaaacagagtcctcacccaggttggagtg

SEQ ID NO: 137488 - DNA, 1061 bp, Homo sapiens
gtacaggtcagagaagtgtggccttggaattttggagccatttgcttagttgggggtgaggagaaggtctatgaacttccctgcttcctcttgcaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtaagacctctgcagtcaccacccttggttttctactcctctctcagttgattcatttgttctacaaacatttagaaagatccctgtgctcatcagggctgtggggggcactgagagtaatgtgatgtaattcctgtcttcagagagcttgcagactgatggggaggtgcaatctgaatgtaatgcagtttatgtttacatagtagctgccctgtattaggccttgagctaagcacatttatgcaggttatctcattaaatcttgaaagtaattctcatagccccaattttatggagaaggaagctgagttccagagaggtgaagcggcttgtctaggatggttcaagcagagccagtagtgggcacagaaagagaagaagactcagcctccacccacccttggtttgctcctggcctgctaggcagatgaaacacctgcttggaagtcagtgagaaacaaatccagggttca

SEQ ID NO: 137489 - DNA, 1991 bp, Homo sapiens
ctgaatgggtggctgtggtctagattccatgtgttcaatttctgtccctgtctcctcttgcctcccctcgcagctgtcatctgggaggtgctgcgcaagttggggctgcgccctgggtatgattgggctctctcagcgcttgctgtccgtgttgtcctttggcaagagaggacggtcctaggattgcatcagtctggtggtctggtggagcgggtggggtgctggactgggtagagggcccagggttctgacctgggtggatgatgggtgaatggtcctgaactctctgctccctctctcagtgtctcttgggcttctatggagcttccctcttgtgctggaaacctcttttccatcttggaaatgcctctgcccacatctgggaagtgccatagccttgagtgaatttatttgtttatttatttttctttttcttctctcaggatacatcattcactctttggggacgtgaagaagctcatcactgatgagtttgtgaagcagaagtaagtatctctgtctggtgttcatgtgtcccatgcatttggcctatttcagaactgagtgataaagccgtggtgcatggatgcatgtgtctatgtgtgtatgtatttgcatatttgcatgtatgcaggtgggattattccttgggcggtgatgggaaacaggagcagcacatgtttcctgatctgttacatatacctcaacatttgtcttgagaccagttctgcaagggagggattatcattaccatcattgtacgtatgcagaaactgaggtttagagaggtgaagtcatttggtcagggttacacaggtagcaagtagaagagttatgtttagaacttggctccaaagccttagttctttttattctgctaactagagcttcatagaaattaatttccgtaaagaaatgacatagaatggtagcttcaggcaaccaggtaccatgctggggagttgacttgtacatctcatttcattttcataactaccctgcagctgtcatcccatccccgttttacagttgagggacctggggctccgagaagggagatctgagcatggcccacagctggtatgggcctggagcccagtcctcttgaatttctggccaaagctcacctatccttggtccttggaggacatgcaaacactcacacagccacacgcatgtgcacacagaaacacacacaaagggtcaggaattcagcatgtgtgaagcatgctgctattggctgttcttcctctgtagtctttctggtcattttctgtggtggacctttctgggcttggccaggctgaggccaagacacttgcagtggggtgtgctcagagcagggggcccaaagaatggctcctctgtttacaacacacccaacaggaatctggggtcattgtgatgagggcgtcaaacttgtggcttccctatgaacaaacgtcccccaacacctctatgtggcttctgggcaagaccagtgggacagggctcaatattggaagaaagactgtagtaattagtggatgatgttgccatctggagcctgtccagtctatgcatgggtaggccatgaatggtcttagaaataaaggctttgaacctctctttccaaggtacctggactatgccagagtccccaatagcaatccccctgaatatgagttcttctggggcctgcgctcttactatgagaccagcaagatgaaagtcctcaagtttgcctgcaaggtaattggagagctccttgagcttggcaagtcaagagcatggggtgcccctggctggggcaggctgtgtgcagagcagcctgcagttcaaatctgaatgttttggtgcttctgttaattgtcaaaacactgtaacaggcactttatctgaatcatttaagccttacaacctgatatgtcattgccctgttacagatgagaaaaccgaggcccagaaaggttggtaggtgacatgtccaaagtcatggggctaggaagtgt

SEQ ID NO: 137490 - DNA, 1891 bp, Homo sapiens
cctcaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaaggtgagatctctgacattgccatccttaactttgtgcttcttttccatttctacccttctagtttgttcatttcttctataaaagttttactttgagctagtccctgtgttcagataggctgtggaagatgctgagaagaaggtgatatagtttctgctccctagcagttcacagattggtgaggaaataagacatccatacactcagctacaacctgtatgtaatactacttgtatttaaatagtagttaccacgtgccaggctttgtgttgggtacagttacacagggtatgtctgaatgtcttgaaagtaactcttaccaacaagggatcat

SEQ ID NO: 137491 - DNA, 4784 bp, Homo sapiens
ctttctgtctggagcaggcaaggtgaggagacagagccatctctttcacctggtgactctggaccttccttctttctgatgatgaagtccaagcatctgaatggggatgagagaagtggcagtaattacaggcggatcccatggggccggaggcctgcaccaccgcgagatgtggccattttacaagaaagggtaagaatccaatgctgtccagtctcttctcttcttcacttgccctcttctctgcctccttccaagttttctgcaagcatgttaagatctctccatctattcctctcctcccaggctaataagttggtgaaatacctgttggttaaggaccagacaaagatccccatcaaacgctcaggtagtgtcctaccaaccctcctccttgagctctcctctccactcccctctcctcccatagtctgggagtaacactttatggcctctttgttctgtcatatctccacacctgccctccttgcactctgccatggctggcatctcccattaactcacttcaggtctctgattgcactgacccaacaggactggcaaaagggctgcagctctgtggcccctgctaagctcagctactctcacctctccttttctacagacatgctgagggatgtcatccaagaatatgatgaatatttcccagaaatcattgaacgagcaagctacactctggagaaggtgaaggggcagtgctggcggatgggcgcaatggggaagctttgaatcgagcaaagacatacatgtcccttttggagagaatcacagaaacatgctaatccagccccattactgtgtgaatgggcagacagtggcctagggagaggtgtagatttgccatgggtcacacagcatgtcagtgatgaaaacatggctaggacagaagccactcaaattagtctcagcttctattcatagttggacatattctgcatgtatttcagatctcacctctcccttgtatccccattttctgtctccctagattcctgctcatcacaaagatgatgttgatgacaatagtacatttgctgtgtgtttactgggtgccaggcacttggctatgtgctttatgtgcattatctcactgacttcttacacatgcagaccccctaagtacactgggagttttaggatgcccggaaagttcactgatacctaagctgaattttgtgatctcacaggctattcttttacttggcagatgtttcgagtcaatctgaaagaaattgataagcaaagtagcttgtatattctcatcagcactcaggaatcctctgcaggcatactgggaacgtaagctgggaaagggctggagtgggaaggaagcttctgcttttatctgtgctgctaccccttctttgtcctacttcccccatcctcttagagagtcaggaaaaacagggtctcaaaagccctgtctcagcacctgcacatagttggagccctgctcacagtagtggcacctgattatgattgactgaagggtataggagcctagggtgggacattcctgctgtcaggtttgctgtctctgtagaagcttcccaggaaagcaggcctgtcattgcttgcctcttccgatggagtgcctggcctggctttgacagagtggttctcaaggagggcttcctggtgtggctggatcagtatgcatgaagcgcaagagtgtcagtggggctgaaggttctgggagagaaagaagggactcacattgactgagtgcttgtgttgtaccaggttgacagccattcttccatcttcttggcaacctgaggaagggagaatatgattttcccattttactgaataatagaccaaggcttgcaaggtctaagtgccttgcccagggtggcatagagctggaagcagagactgggcagaattctgtatctgaggaatctgggagaggttagcctggtgagctggctggtgtatcttttgcggatggctgctgaaacataaaccttctttctgtcctgttgaaacataaaccttctttctgtcctgttattcccttaggaccaaggacacacccaagctgggtctcctcatggtgattctgagtgtcatttttatgaatggcaacaaggccagtgagggtgagtggctgggcatgcagctgaatgggcggccatggtctggattccatgtgttcaatttctgtccctgtctcctcttgcctcccctcacagctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtaagtggtgtttggggctttgtctggccctgaagtgttctgggtatactgatctggttcagaaagtgcttagtcagtgcctttcttatactagctttagagggatgggcatcctgtgtcctagaactgatactgtctaaaattcccatgggcagacctttccaggactgggccagactcaacacaaggcccttgcagtggggtgcgctcagagcagagggccttaagaatggctcctctgtttacaacacacccaacaggaatctgggcttactcctcacaggtggcatgatactttggccttcctgtgacatcatgccctatacatgtctcccctggagaagcccaagggactgctttgcacagggccagtgggaaatggctcagtattggaggccaagaccataaactgtgtttggtagtgagtctggggctggagggtcttagaaatccctctccaggggctgtttgtatttgtttggaggaggttgccacctggtgtctagtgcttagacagcagggttgcttggttagaaacaagtttcatttcctttttccaaggtacctggagtacaagagggtccctaacagcagaccacctgaatatgagttcttctggggcttgcgctcctaccacgagactagcaagatgaaagtcctcaagtttgcatgcagggtaagaggagagctgcccgagcttggcatattaaggcaatgggatacccttggctggggcaggcaatgcacagggatgggcaggtacagagcagcctgcagctcatatataaacatgtggagcctcctttatgtcccagggtgctgctagatatatagtttacatcatctcattcattcttcatactttgtattaatcagcatgggctgccataacaaaataccatagactgggtggattaaaaaacaaatttattttctcatagttcttgagggcgagaatcctaggtcagggtccacgagggtcagttcctgttgaaggctctcttcctggcttgcagatggctgccttcttgctgtgtcctcacatggctttgtgtgtgagagagaagagagcaagctttctggtgtctcttcttataaggacactaatcctgttgatcaggaccccacccttatggcctcatttaaccttaattatctccataaaggccctatctccaagtacaatcacactgggtgttagggattcaacatacgaatttgggggcgggcacaacccttcagttcataacatatttacgctctatcatttcctgtaattataaagacacttaggctaagtgaggttaagtaacttgtccaaggtcatatagcacgtaagtcagcagagctgaaactggagttcagaactgacccatgatagagccccaataactgagaagtttaaaaaagtattgctactagtttaatacaaagcccgtaggttaatacatgattactagggttgttttcttattatgattatcatccccatttcaggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtga

SEQ ID NO: 137492 - DNA, 1021 bp, Homo sapiens
ggcttctggacagtaagtacagattgattttgaatcactggtgtaagaatggagggaagggcagaggtcactaggggtggacataagaacaagggagggtttaattgggataggagaggaaaacttgggcatattgtatagactgtggggcaaaagctaacaggaacaggagatagatatggaagagtcaggaattgactgaagtagcccatccctgagaaggtgggatggaatagggtaccagagaagacaaccctgactttgaacagacttaagggtggctgtggatgcagataaatatagatctgcttcaagcagggatcagcaacttctgtagtagacaacaacaacaacaaaaggagaggtggattatacaaggtttaggtcttgctgggtggttgtgatggaaggacaagggaacaaaggcagcaagtgtatgagtctgtctctttaccactgggtcactggtacctggcttatggtagctgcctggagagtggctgaagagatggcccatagtatccaacatagttagggacagaacactaaggatagattgggggacaatagagcattcaaaggactctgctcttgatgctgtacagcaacaaatattgttcattcaaaaaatactacagggctgggcacagtggctcatgtctgtaatcccaggactttgggagaggccaagatgggaggattgcttgagcccaggagttcaagaccagcctggataacatagtaagacttcgtctctacagaataattgaaaattagccgggcatggtggtgtgcacctgtggtcccagctccttgtgagagaggctgaggtgggaggattgcttaagcccaggagtttgaggctgcagtgagctgagattgcaccactgcacttcagcctgggtgacagagtgagaccctgtctcaaaaaaaaagaagaaaatactacatatatgcctactgtatggaggcacactgctagggattcagtggatgacagagagttgtaaggactggggta

SEQ ID NO: 137493 - DNA, 1056 bp, Homo sapiens
gcaaggacatttttttggccactgggatcttcccaacctcttcactggcactccctgctttcagtgtttaatttaggccagtatcgacgagaggcagtgagctacaagaactatgaattctttcttccagacaacatggaagccctgcaaatcaggaagtaagtacccaatattttaggaacctgtgctgtctcatggctgaaaggcccttgttcagatattgggggagtagggcagaataatctggaccagaaaggaggccctctagactctcaaacagtagttggaacagcccttccattttcctgcccaaatcctgtttctggtcaagaataatctggaccagaaaggaggccctctagactctcaaacagtagttggaacagcccttccattttcctgcccaaatcctgtttctggtcataaccatccacttatcaagaacctttaatggtcttctacttctgacaggagagagtagaaacttctcagcttagcatttgaggcatgaatctcaataccttggcctactctagtttctgtagtctcatcagttcaacctcaaggtctctctgcactacaagactctgagtacttgcagaatagagcctgtgccttatgccttcattatagaacctggcagtgagtaatcactaaagagatttttgctgaaagcataaatacattgccactgtcatgcctgtgtgttacccatgccaggaatgccttttacttcacagaccacatgctctacttgggtccataaaacagttcagcttgagttccattagctcaagggttggagcccttaatattatggcttctgtcattgctcagcttttcctgattgtgtcactttatacctgcccgtaaaccgtgtaagctgtgcacacatagccactttcaactgtttgacccctctgtgcttagcacggtgcctaaagcgtagggcaccctgtgtagatgttcaatacatgataagttagtctaagacatgagagatggtacagaagatactgcagacaatgagagagaaatccatcctgggggataagg

SEQ ID NO: 137494 - DNA, 1041 bp, Homo sapiens
gatatgcccaatgtccagggaaaagcataacgatgcatctttaggttcctcacccagaattgcagcataattatttgttccccagaatttaagtcttagagccatcatcctcaatggttacagcaaagacgcagtaaactgcttttcctcctggaggacttaaaaggttaccagttgttgctatcagaaaatagctctgtgattaaaataaaaatttgcatgtcctgagcttcttcatgctttgggagttattgactcaggattgactcccatgagtgcgataactaggacaaaggaaatgaacatttttattgctcttgcttcatattgccagattgctttccagtaagggattatgcccatttacactgaagatcgatctgaaactcagcaccagcgaaatccagaacttgcctgtctccatggctggttttaatttccccattctgcagtggcttgttaatattagttctgacctttggggcaaggtgaacacatggttggactgaagagaaaaggcttctggtggctcaggaacgtctttggcaactacaacagctgatatttcaacagagcacatacatcccccacttaacaagggtacgtcctcagccttctcagggaaccaacgaacacctccaggcttcctctttgatgccacccactggacctgccttgggggtctgtaaatgcaagagaaccgagtgttggataattagcgatggaagaaaaaacctctagaataaaaggtaggtgagaaagaagggaaagtaggcaggagttgcacaaatccacatccattcttcaggccctctggaaagttttctttgcatagatggttggttgtcgtgtgcattaaagggcatgggaaagtgggggaaaagattatatctatatgtaacctatttatctgtctgtatatttttaaaagtccattctggcctttatgggacactggcccccagggcaattcactagcacctgtgaaagtctctctaacttggtcaagtctggttttgaatgaactgagtgattgagatt

SEQ ID NO: 137495 - DNA, 1729 bp, Homo sapiens
agacccctgcaaggggtggcaaatcaggaacccagcaactgtgccgccgtggccgtggggcgcattttggacgagctggatgcggatatcgtctgtctccaggaaaccaaagtgaccagtgagcgctctggattccaggatccctacatactttttctttcccgctaacttttgtcccctgtcccatgtaattttactttcccagtttcctattcttagagtcctgtccttagacccaggtcccttccctcttaaacttccatttcccaccctagctagatcccctaattgcactccatctcctgtcttcagcaaactttagctccttctcgaaaccccatatctagtcagattcccactcattctccggccccaaactcagtcccctgaatttcctccttccatacgctgtccatctccccgccgccaagtcaaacccccgaattcttcatccctgccccaagctcagatcctctaattcccaccccatctttgaccccagctcagtctaatttcctctttttcacatttccacctcagaaccccagtaccccttatctattcccatctctcctcccagcggaaagtccctaattcccacctcatttcccaccccaagcttagatgtcctcttatttcttcaccctcttatctcccctcagaatcccctaattccttttccctccacccccagttcagatcccctaattccctctctcttacctctcacccttagctcagattcccaccatcctctcgtatgtccatccccatccccagcttcctcctatcgttcagacccccaggcttagctctgattctttccccttcccacctaattctccacctccacttcatagtctctaaccgccccccaccaagccttctaattctgatatcaatttcctctctgacatttcccatctttctaggtcctcctctaatcatggatatttcattcccgtcacccccaactctggctctgatgtgtgcaaggaattagcctacaactgtaattccaggcctttgtgtttctcggatgctagttttacctctgacttaatcttacattttttttttccaggggatgcactgacagagcccctggctatcgttgagggttataactcctatttcagcttcagccgcaaccgtagcggctattctggtaaatggggctttctgtggactttaaattagtgagggaggcagataggggaaaagggtttccaatatttgatgagagggtaataagaaatcttagacatttagtttacagagctaaagctgcataatagtaaattacatgaaatataatttttatggatagaattatcctactggacctcagaagtacagtagtagtgtggtgcttaattgtgtgaactgtggagccagacagcctgggtttgaatcatggctcatttcctagctgtgcaccctctggcaagttacattacctcttggtgcctcaggttcctcagctagaaaatgaggataatgtttaccttccggggctgttacaaggattaaatgaattaatccatgtgataataataattgctaatacgtcttgagcactcaccatgtatcaatgtaaaacacttagaacattctgtggcttttttagatgtaggaactgagactccagggtttgaataaggttgcccaagaaccacactttatgaagatgacttagatgacttgtgtggggacaattggagtggga

SEQ ID NO: 137496 - DNA, 1875 bp, Homo sapiens
attcaaggctctccttggtctgtgacctgtctcttatttccaccttcagtgtccctacacattttgtcctctctagacaggttgtctcctgtcggcccgttgtaaaagttattctcattctggcttttctcactgtgccctgaattggtggacatgaccccctccctgtctttttgttatatgaacctcttatctctaagttcccctaggcccatggttttcagcccctaactgcatattagaacaaaaatatcaatatcttagcactactccagatcaatgaactcagaactctcgagtgtggggccagggtagtggcacgttctaaaagcccccagtgtgactttattgtgcagccaggcttgagaaccactgccctagaatccacaagccagctctcatcttttcttgccttatgtctcacgatgggggatcagtgatttatgctggtacagtcctactcagcactgggcttggcttagagaagggaccgtgggaatattccttgattaattcacagaagagctacataaatgtagatatggctcccagctgggaaaatgagcagaagtgagagaatgagagaatggtggtggtggtgtggtggggagcggagataatgctacaaagtgtgagccttcagtccctccctgcctcattcctcttatgcattcattcagtgtgttctttcagattcctgtgatagcatcatacatctttgtgccttttctacttagttcagaggtatcctagatctcttatgtatacctctttcattttctcctccaggaaaagagaactaatagtgccagctcagatgacttacacagtctttccaaaatagcagaacatacccactttctaccaggcttgctcttttagtcttgtcatttctgtaaatggcaccatcatccccttgattgcttcaacttaaagcctgggaattgtgctagtattgtctttctttcttactccacttcccacattcagttagtcagcaagtactgttgattctagctacaaatcatctcataatttcatgtttctgtctcctctggcacccaccctagtccaagtgaccatcatcttgcttgtgtgactatggcagccatttcctgctggtattctggtctccagtctggtctttcctcaagtcttttgggtacgcagcacactccctccacaggcccagcacagagactgttcttaaagttaggagcaccctccacctaggttactcttactcagcccccacacctcagctccagatcacttctcgaaaggaagcctccttggtccccaggagtagatcaggttcctactttgtccctggcatcatgcatggcacataataggtattccatgaacatttcttgcattgaatgagtgggtgggtaggtggattgaatggatggactgatggatgatggattggggatcagagcctaaggaagtattcagacctggatccttgcaggtcctcagctcaggaggtaggaatggtcattgagggctttgacacactagataaaccaaatagtgccagagggtttaaaggaagaagctgacagtcttcctaactcttaaccccagccctgcttcctagaggcaaacacttttaacttcctgttttccatccttttgaaaagcagttccaggaattgctttgagtaagcaaactttcagatttgccattgacggaccaatgcaagacaaatgcaagctcgtgcagagggaaaaacaagcatggtcttttaaatcagtaaggatgaaaatcagaatcccagctctgccaattccggactgtgtgaccttgagcagtagtcctcttgggacaaccaaattttcttatttgcaaaatgcagcagttagtct

SEQ ID NO: 137497 - DNA, 2571 bp, Homo sapiens
tgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttcctgtacggctaaggtgaaatcagcaaggaaggtgggctgtgtagccttaaaccagagctttccagctagtgcgtcccacagctgccacagtgggttacagggttgaaagaaacggtcctcagccctcagagttgccaggcagggcctgggaccacacaagtttcagggacgattgcctccttagcaagtagtatcattagtacccctaagtgtgccatggaaatgtttcctgtatactgtgacctggaaagtgggagcattgctttgaacacagtgcttgctctagccaagcctcttctcacctttgaaaatgggactggtagaccaggcacagtggtgcacgcctgtaatcccagcactttgggaggctgagatgggtggatcacctgaggtcaggagttcgcaaccagcctaacatggtgagaccccgtctctactaaatacaaaaaaattaactgggcgtggtggcgcgtgcctgtaatccaagctacttaggaggctgagacaggagaatagcttgtacctgggaggcggaggttgcagtgggctgagatcatgcattgcactccagcctgggcaacaagagtgaaattcagtctccaaaaaaaaaaaaagaaaagaaaaagaatgggactggtaaatcctgttctgtgggatgccgtgggagggagagaggataatggattgaggaagacatccatatccccttatggaaaatacctctttggttttggggaaccactcctttctagggaatttggttagggctgactcatttcctggcttcaggggctaccctgggcccagatttccagggcccggattaccagtgaagcgtcaatccctggatttttattgaaaccattggagaagagccatctcaaataaatctgccaagtatcctagctctttgcaactcactgtgtagtttttgggcatttccttcctctttctcattctgtttccctgttggtaaaatggaatggtgaccaacaagtgacctatggttacctcatagatctgccacttgtctgagggagtcagaatgcacttgtctgttccctgtccaataaaaggcttcacatgctgtggtttgtgctttatttttaggctcaattcagctagaggcacacaacaaagcagaagacaggagtaggcctggacccaagtgaagcgcaggtggggtgtgaatcctaggcagctggcttctcaggcataggtggtgacatactggggccccatgttcccgaagtaggaacgttcccactcactcatgagctcaaagtgtacaggacggcgacagaaattgcag

SEQ ID NO: 137498 - DNA, 1059 bp, Homo sapiens
aaggtggtagggggaggggagggaaaaaatgggttagactagatcttccaaatctgtcacagtacagatgagccaagatattgatccccctcaacccttcaagatacctcagggccagaagtagcctactgtttgcttctgtgtgtgccgtgaatattaccatttgtatctggatgctgggatatatattataaaagatttggaagctctcctttgacacaatttgaagccatactgtcctggcctggaccactccctaagtataggatgtgctgtggcccaagaatgactgtctgcttgggaactctaagccctatgaggacaatgataatgacagtaactatactgtgtcattggtgctatgaccaggaaacctggggtagggggtccacctgggggtgtgaaaacccagagaagggaacctgacctagctggaggaagtaccccaggtacgttccagggctctgttcttggccttttctgtgttcatgcccttgttgatcttgtctagtcacatgactttaaagaccatctatatgctgatggttcagaaattttaatctccagctcacgccactctactggtttccaatcttgtatatccaatggcttttctccatctccacctagatgtctaatatgcatttctaacttaggagtacaactgagctactcatgtccctaccctccaccaagctattctacttttagcttttcccatctcagtggatggcaattccagttgctcagtccaaaaatttcagagctatcctttatttttctctttctctcttaccctatatcccatctatcagcaaagacccttggctctaccttcaaaatctgaccacttcttattgccttcattatgatcaagtctgagccaccatcatctctcacctgggatattactgtagcccactcttgggtctccctgcttccacccttgctcccttttagtgtattctctacatagaagttggagcaattttgttaaaacccgagtcagaaatatcagtcctgtgttcaaatcctttcaagggctctcagagtaaaagc

SEQ ID NO: 137499 - DNA, 1892 bp, Homo sapiens
ctctatgtactcaatttttctgtctcccacttgcttataccattccacccacacccatcttcttactgttcctcaaatataaaaggaatactcctgtgtcttccctgccttaggatgttccctctgcctgcgatgccattcccttagatatctgcctcactaacttcacctccttcaaatttttgctcaagtttcacctcagcgtcttctacccttgccactctaatactacaacccttctctgaactcgcccctggccccttatcccattctccttatcctgctttattttttcccatagcacttagaactaatgtgctacttaatttgcttatttttggtaattttttttactaccccttccactagaatgtaagctccagagggtaggaattttgtgtctgatttgtttgctactgcatccccagtgcctagaacagtatctagtacacagttggtactcaataaatatttgttgaaagaatgcctaagttaagtctacaagatgaaggaaagtaagccagaggaaagtgtgagggagggcattccaatcaaaagagagcagcatgagcaaagtcccagaggtaagagagcagaaaaaaatgagggaacgacaagtccttcagtgtagctgaaaaaacaaaatgcatgtggggaggaggtgagggcatagagatcaccatgtggaaggcattgaatgctatgctgaagagcttcaactctgtcctatatgtcaatgtttccaaattttggactatacatccctatcagtacaaatgttttagcatgtacctccaatctctatatttgtttatatattatatacatgtataactgtcagtctgtatattaaagatcagtatcagtgatgcttgatttcctatttttaagataaaaaaacataaaattctaatacatattctgttccttcaccctgtaatcattttgcataccccttggaggtcactgctttagagtctagagggaaacatgaaggggtttaagcaagggagcaatatagtcagaattttagaaaaatccctctagtggtcatcatcgagaaaggatttgagaggagcaagagagaagcagagaaattaggaaaaaaatcatgttgacatggattaaagaagtggcaggggagaaaagcaaataggtttgagagagattatagataacttttgcaggatttcaggatggattggctatggaacttagggactggtggagccatcgtggatgcctcatatattcttacaaaagcctagcctaggtggacattcagagaaccaagaatactgagagctctacaattgaagcccagagcaaaagagaatactgaacaaaaggcccaggagtctgggtcatcagctcagagaggtggtagacctagcagttatgaccatggaggtagagacagacctcccagttgcaacttagaagctgtgtgaccttggatcagcgactatatatttttgtgcctcaatttccacatgtacaaaatggaaatgataagaggatctctaactcttgaggttgttgtggggattagatgagttaatacgtgtaaagtgtttagaacagtgcttggcacatggtaagtacttaatgttagccagcattatttaatgtttttgaatgaatgaatggcgcctacctagcttgtcttccttgaattctcatactgcccatgcttcagacaaacagaattatgttgtcaatacatacccactgctttcctatctctaggtcattgctcgtggaattcccttattctggaatattcttacaacatattcacatgtacttcaacatgcatcataaaaacttccttactcacaaagcctctccaatttcatccttcccaccctctctctccataatgtgtccac

SEQ ID NO: 137500 - DNA, 1023 bp, Homo sapiens
gatggttctgggtgagaagataccccccaccaagccaattctggaacccccgccaagccaattctggggtgctgtcactaaattaattcataaaatgagtgtttaaaggaaatactaggttagtctaaagagcagtgactatttctcatccacaaaattgtcacaaataagtgtcctttccctgccctggcttactgactcacacaaatacgtgttatttaagaaagaagtagcagttcatttttaaaggcagtaaatgctcatattgaggatccaaagtagcagctaatcctatggcttttgattttatttttctgccctcatttctcaataagaagtacgttttacaccgtgaccataaacgcacacatacacatacatgtgtatatgcaaatacccaaaatgcatacaaatttttcacaaattgatgatacccttagtatgtgatgtactccaacattttctgtttcttttctttttttaatgctaatgataacccactaagctgattttgtgacccattaattgtcttgatccagtttgaaaaactctgaattataggctgtgagcactcgctattgttagggttaggataatctaataagcatgaggtaatggctgatgcaaggaaaagactggttaatccagaatggctgataatttttcaaaaagggaaacaaagctggcaataaagggaatggttagcaggaaagcaaataattgaagacagcaacagatgtaggtttgttgggagcgtgaggctcccagaataaataggtggagagggcaatgggcatggtggggctctcacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcacca

SEQ ID NO: 137501 - DNA, 1225 bp, Homo sapiens
atttctaacaagagaagtgttactcgaggaattggagttatatgtgttagggtgcagatactcactttagcaccaacttgctgagccactcaagatgaattggatgccaactctgaactttagtttctttacctataagatgaatgtaatagctgcctccattctttggcatttactagctgtgtgaccttggacaaattactcttatgtctcagtttcctcatgtaaaaaatcaaaataataataacacctatcacatagaattgttcagaaaattaaatgaattaatacatgtaaaatactaataattttgcttggcacataataaacactataaatattagctgttataatgttatcgtcatcatcatcatcatgatcatcatggtttttgtgagaccaacactagtaaacatacactcactcatatacataccatccatggagtggacagtctcaaaggccacaattttgggtatcttagggttagacttctctagaagtttctttaggtggtcagggtcattgtgcctgaagacaaacttggctgctccactgttacggataccttggatcatggaagcatggttgcctgcgtctgagtaaatctcgcaccctgaggaagcagatgtataatccttaagcttctgtcccagtactcccacttcaaccttcaggtttgacctggcaaagaaaagggccaaccctttcttccctttgaagaccttgctctgcttcttccttctctgggaacttttgtgacacttctttctcccttggaaggacttcactgttcccaaattctgacccctacatccttccctccagtcatttgtaaccctggtctagcctctgactgccttggggtggaagaacatttaatttcccaagaagcttcagagttttttgaggacgggacctattttccttctccccaatatataagatcaagacttgaaaaagggattaccccagggaatgtttgttgactcggactgatgctagattgttcctagtctagatgaaattccatccattccaggtagcatctgcttgtggttacagggatggatatttatcaggcttttactgttggaatcataagcttatggcatgtcagagctggcagggctgttagtgatcatgggattcatccctttactatacaagtgagaaagctaaggtccagaaagatttgaagaatgcagggctttttactgggcaa

SEQ ID NO: 137502 - DNA, 2961 bp, Homo sapiens
ttgtaaagaatagattatcggagggcaaaggtaaaattttctttaaaaaatgatgttggatcaggctaggatgctggcagtagagatggaaagaagtttaatggttgaggaggggatggactaaaaacaacttaaagatgttgagtttagttggggcttatgggtggactcaaaaaaagtttctgagaagtggtggtaatatttttgctgtgctgaagaatcagcaggaggtgaggaagtagatagtaagagcgaagacttctctcaagcagtttgcctgttatagggaggaaagagggcagtagctagagagtgatcaggggttgaggcaatgtttttttataagatacaagagacttgaaaacatgtttaaagagagggagaggctgaagatacaggagaggaggagagagccaataggtcaagattcctaaggtggtagaggggaatggggcacagagcaacagtggaaggattagtcacaagaaaaaggatacttcttccactatgacagaagagaaggagtgaggagaggacatttgaagatgcttatgagtttgtaggtgctttgtggctgggagtcaaggacattgctgtctggtatcttctattttgaatgtagtagaacatgaagttgtctgctgagggagatggggaggagggggtgtgggaaggctgaggataatggtggtttggcaaaactgccccataaacttcgagaactgaccagggaaatgggattgtcagagaccatggagaacccagtagaggttaagagtatgaatttttagtgactcctgtctgagcaactgtatgagcccggaattgatatagtgaagatggagggttgtattcattctggattgggccttggcggaaggacaacaaggcgtatgaggtgaggacattacagactagagagtaggagactgggaatatgggaaccagtgtacaagtgaagggattggttttaggcagaaggagagatatgccttccattgtaaaaggaaagaatgaggcaaggctagataaacaattagataagttcgtaggtttggtggcaataaataaggattctctgtctggggcttctgtttttattgtgaagtaagatgtgaggttatttgctaagtgtggaggagaaggtagtcagaggttttagaagaggagaagaagtttgaaaaagctcctgtggagacataaaataactatgtatgtgtgttaagagctcagttgagttgggaggtgatgaatttatagtgtttcctttctgtgaggtggggtaatgttccccggtaatggtcctctctacgtgcagaaggagagaaagcagagggatataattatccagtgttgaggatatgcaaggtggataagaaggaagaacaatgggagtgagggaactccaaatacagggaaggagtgatggaaccagtgaaactggatgctgtattgcaggataccagccctgaacaaagctcaggcctcaggcttacctggcaggatcttggccaaggtgaagagagtagagtcattggcaacaaagcaggaggagaagagcagggctgagtccttctggtgcagctcagccagctcctgctcaagctccacatgaaacttactggtgcctgagatgttgcgggtgccaccagctccagcaccatgacgctgcagggtctccctggccaggagaaaacaggagaaaaggagaaaaagaaactcttgtcaggcatcgaggaactgggtaggtttctcttccttgatgggagtcaatgttgagttagtgatcctatataaactgtgtcctatgagacaaagtagagggaaggatggggaggatagggagacatgtgccttccttctaggactggaggtactcagggagagagggagaagctaggttgagcttgagtagtttggaagacctagaggaagtcacactccatctctggcaatactaattctgcagctagattaaaaactcaggcagagtgggccttgcttggtctcccatccttcccctccatagcattggacaccgaagagtttgggaaacatggtgtgttgacttatttcatatccaaggaatagatatgatggaggaccttggacaaaagaagtggtgatagaacccaagtttccactgccagctctgccttttttttttttccatgtgtggtttttcatctcctctggccactgctgatggctgaaagcctactactcactgtgtggcttgcaagacctgagggtgtcggctcatgcccaggtaatcattactacaccagacggacacatcctttgaggccacagatgcctcagagaaatgttgggcaaagggatatgcatcagcccagcggttcacagtcttgaacacacggtaggtgtgatcctgtttcttctccatgatcttgtccctgaaaaactggtcataactgaagacatagtttcctgcaggagcagatatgaggatgaaaagaattcgttttaagtctctccctggctagtctgtattttacccatgttgctgattttgagttctccaactctttttccacatattcatttatttgctcagtcattgacttatggaccacattaactctctactacttcattcagccatccttttgcttactcattcactcattcactcagtagttcattcacacattcatttagactttcttatggcctcatctctcttcccgggttggtgtggcagcctccttactagaatcactgctttcagtctcactggaaggagtatcaacagatcttgtttctagcgatctctttgccacttcctagctgtgtggccttgaacaagtcatgaatcttctttcttactttaaatttctttatttgtagaatgaggctaataatactttccttggagagttgtgagcatctgacaaccaacaacatgtaatatattcaaactaataaatggcacatggt

SEQ ID NO: 137503 - DNA, 3756 bp, Homo sapiens
accactgtttgtaatagaaaaaattggaagcaaccaaatagaggagtagccaaataatctctattatatctatactacaaaatattttgaagcattgaaaaataaggtagatacatatgtgttaaagtggaagcatttccacagtatattgttgagtgaaaaaagggcacagagtaaaatatatagcaagatattattaggtaaaaataaaaattgaaaaaagtaatactatacattttctttgagtacatttgtatgtatgtaaaaccaacctacaatctaaactgagagaatacaaaaaattggaaacaacttaaattatagatgcttgattaactgaatgatattgaatccatactatacccatgacatatttttaagtgaacaaaacagcataacgaactccaggtaaaataagatcacacttctaacaaaagcatgggtgtggtgaagagagcagagggtgtgtgtgtgtgtgtgtgtgtgtgtgtgtgtgtagccatagaaaaatatctgggagaaaatataacaaaaacttaatggtggaactctgcatgacttaaatttccctccttatactttcctgtatatgttgaaaaatattttaccatgaatcatattccttttacattagaaaataatgtaaatgtcattatggaaaggaatataaacacatataagaatggggaaaaggtgctgtatgaagggtgaaagtttttgagggaagcatagagaagaaataatggaaataagcctaatatttaatgaagcctcattagaaacacttccataaatgtaatttcactttcttctcatggtaacctattgaggtaggtattaaatgccactgaaggaaagtgtcttacttgccaaaacacctagatccagcaagtgccagcattaaattttaaactcaaatttcctttggttccaaggcccttctgtactgtttcccctactgtgacagaggccctttcagaatgccttccctattccggtcccctttttttccacctcagcaaactcaccaggcatattgttctgaatcaggtgtgtgaccttcccagagatctgctcctgctcctggggaccggaaaatggcttccttaggctgactgagaccagggagctaggcagatctgagacggaatgtgagattcattggccgtgaagagaatgggggaaaaagaaagcatgtgttgtcctctttaagctcaatgcaacacatgaaaattcaagtttataaggtaagggcagcttctacagcgagaagaaatcttctccaaggtgagcttctatttatccccccgaatggagactattacattgttaggaaaccttctataaggtgaatcatacttctctccactaggattttcccttggctcaggtaactggagcagccaccctgggtcctgcatttagaaagtagatgcaggataatgtaccttactcttcttttctaaacatcattaaatttcaattttgaagtttttgtccttaatgatatcccaaaggggcctatgaaagatgtcaacagtgtggccatatctcaagggtgattatcttgggtggtctgcactaattaagttgacctggggatctgcaccctggttaaaggaggtacctactcccagctctttctctttcatgcaaatccatattctcatagagtggtcttgctgaaatgtgggaccccagcctgttgggatcagtttagccacctgaaaaagaggagtcaaaattctagagggctcatcttagaataatgactaaaagtttcaggagcccgtacatatgtgtttgtcaggtatggtgtgcttcagcatacagcctaaactgttgcctaccatggctcccctggaaagactggacttctcatcatgggatgtgtactggctgcttttgtattagcctagctcaggactgtgacgtagtgtgttcaagcattaggagtaaaggttgcataaggtggaacttgactccaacctgtcttgaaagccttcacatcttcctggacttctggggctgccttctgcacaatcttgctcttcccatcctggagttccgacagcatgaagggacagtggcccttcgcccaagatggagaatctatgcaaaggtaagagagtaatttggggtgcatttctagtcataagttcagctcaacaataattgctgagatctaatgtacccctaaagccctatctcaggctattgtagagacacagagatagatgagtctggtccctgtgctaggggagctactaaactggtgggaatggcatacactgaagacacattgtgaacagtgctgggatagaggaagtacatgggctacagaagtccagaagagggaggggaaatgagccagaattggaattagacagtttggaggtctaagcaggctttgcagaggagatgatggccaagcttagtgtcaaatgagaagtatgagattctccagtacagggtctaggagagggtaatctgacaggagcaaaggcacaaactcttgacagaatagttgatttaggcaattttaagtagtttcagcatgtctggagtatagtgtgtgagggacatgacagtgagactgtttcttttcttttcttttcttttctttgacagattctcgctctgttgcccaggctggagtgcagtggcatgatcttggctcactgcaacctccgcctcctgggttcaagcaattctctgcctcagcctcccaagcagctgggattacaggcgcccaccaccactcctggctaatttttttatttttagtagatatgggatttcaccatcttggccagggtggtcttgaactcctgacctcgtgatccactcgcctcggcctcccaaagtgctgggattacaggcgtgagccactgtgcctggccgagaatgagactctttctagagaacctggcagaagacagattctgggtatattttggggccagttcatgctatcttgacacttttcacatgaaccgtcctaattattaggcaaagatggccagtataacttggaacttttaccccaggaccctaacattctccccttttgctagcagcctcttcttacctcctccagcctttgttgccttaaggtggatttgagaacagtttggtccttgggtagccaggatgggacagcgtccaataccaaacaggaactggtgagtcttaaccaccttgcctaggaggcttgtggggccccgggcaagcactgggcagcactgtagcagcatggctgcagtcaccatcttgaacctaaagtcctgcagaagacatggaagagatgaggttccatcatgagggcctggcaaaaagccaagcctttgatcctcgtcttcagcttcccacccaaaacttgctgcctccgagatgctcttattgcccttccagggaaagaacttctttcccaatgttaacatgtaccaataaaacatgagggaggaagaaataggaaactgactactgggcaaaggggtgaaggaaacagttctaactggaggtcagaaagcctggattctgactcacattctggcactgactacctctgtgatgatgaggatcactgaaatgtgtttttgtgtggcaggatgagaactgccaacccactaaccctttgatcaatacttaaggccaagaatctttctaagaatgttggtcttagccaagtgaagattcagcctgctaatgcaaacatatgtcattgagtagagctcctgaggcttggcccagggt

SEQ ID NO: 137504 - DNA, 1814 bp, Homo sapiens
gtttaaggaaatcaagggatccggaaggaagggtaggccctaggtcctacagaatgtgtaccaccagcctgatattatgctgtctttgaatttgctcctgtctcttggataagcacagatataggaagaggtgaaagcaagtcccagtggggctggaaaacagggacaaagacatagtctatggattagtgaaacaggcagaggccaagacagagaagagaaagggggcaaagagatcagaaaaagagaaagcaaatgacacacaggcactcaataaatatttgttgaattttggggtaaattgatgaatgaacagagtctgaaattgaggaaggagaagggactaggagaaaagccagaagaaaagaaaatttaggaaagataaaaggaggaaagtagagagagaacaaagatgtggtggtggtggtagagttaaaagaacagaaattgagggggaaaaagagatcaaaggtagagggaaagggagcagggtagagatgaaaacagagattgagtcgagagaaagagaaaatgaaaaaagaaaaagggggtggtgatagtgcacacagggataaaggcagagacagatagaccaaggggcacgaaagggacatgaggagggatcaatgagtctagaggattatacaaagattcatagaagtgagaacaggagtggagaggatccagcaggggtagagagtcagtcagacacaaacataaaaaaatgctgccagaaattgcaaaaggctaagtaagtttagggaagagaatcatggccctaattgagggagatgagagagagactgagggacagagagaagagagtagagaaaatgacaagatcaaaggatagagacagagaggtgactaaagcagggggatgagggttaagaggggtgagagctgagagacaccaagagaaagacagctagagagagcaagaaggagagacagatgtaaagaaaaagggcaaattggaaagacagagtcaaaaagtgagacaagataagggacagtacaatgggagagacatgggagaatgtgagaagactaaagcactgacactgtgaagaaagttactgagtagaatctactagcaccctcagccttatgttttgagggacaggtcagctcatggccctgccctcatatggcaacctccttcatctccctcccttcctgatctcatagaacaagcaccctccccgtacctcacaaaacaacctctttttcttgttccatcccagagcaacctctccccctctcatgggctgtcacagcagcctgggttggtatgtggggccaaggcatgtgggccctgaaattggaaaagacagaagggttgttggagggactaaatgaaacaatccaagttaagcctttagtatagtttttggcacatagtaaatcttcaataaatgttagcttttcttattaaaattccagctctccaatttcattgttggatgttcttgttcaaatcacttcccctctctggatcttggccttcatcagctgtcaaacgtgaggtaattatggccacttcacaaggtaggtaaggaattggatccagtgcctacctcatatctggagatatgtgtttcccttcccctgcctgcttgtgaaagctaaagcacttggggctgagcctgcagaccacagataaagttgccagagtttatcgccattggggtctgaccactccccaagctgagaccagggcgtgggagagaagaggagccccttcctggaatcacgtctgagcatctggctagagctggccctggctattggtggtaagaaatggatggccc

SEQ ID NO: 137505 - DNA, 3338 bp, Homo sapiens
ctttgggaccttagaaaagtcacttccctgctgtacatcttatatctggaaaatgttggtaataacaaggacaatctgcatcacaggaatgttgtgaagattcagtaagataatccatataaagcatttagcagagtacctatcccagagtaaacagtaaaaaagtgttaaatattatatttaattgatagactttattatttttattttctccatttcccatgtagaaaaaatgaacgtacagccaagggaagtcacatgaatataccaggctgggtttgggaagctagagaattgattcttgtcccaatcctgttacaatttattgtgtgaacttgggctctgtaattcccctctctgggcttccgtttctccactgacattggactagataatttcatagattccgcctagttctgatagtcaaacacttacagagccctctgtgccaggccgtgttctcatgtcaaccctgtgatgatagggaaactgaatcccaaaaagattaagtaacctgtctagatcagaaagctagtacataggagaagcaggatttgaacctaggcaatctgtttccagagattcctaacttaaccattatggatctgtgattcaaatattactacctttttttcttgactgagggcctgactctagacatttatctcctctgctgcactaacataggcctctttccaggtcatatgccatttgtcaccaatgccttaccaaaggaacagatctgtaactacagtggaatttcaggtactgttgaatattcatttactctaccattcaataacttatgtacctaatgtgtgataatgcttgccaggcatcttcttaaaacaatacttttaaccaaagagatgatggtgaaatttgagaccaagtaacagatcattactgaaagtttttccctacgactttaaaatcctctcttgtgtcagcacccaatctgtactcccagaggtgaaaagggccaactgcaactctaccccagcagacagccagaaaacactcattgcagcattccttgtcccccacccccccaccccttttgtggcctgctttgcaaaagtcaattaggtctggaagggaagtggtaatttctcttcaggagttggaaacatcaggccttacttctcttcctagtacccctttcccaccatgaaagaatcatacagaactttagataactgtaatcagagaatcagaaattcttagaaacaggaaaatttagaagatcacaaaatcaaaactagaaagggtggtggaaattacaggccaagcctttttttcagagagtgaatgacttgcctagggtctcacagtgaattaggatgagaatagaaatctgtttactttctgtatagtgacactacattcctcttccactttcttcacttatttctgctaattattcatctctcaattccccaaatctctccttacccaattcatcattcccatcacccccacatcctcttagtttccctccctagctcttcccccacccctaggctccccatgggctctgacccactgagctctgctgtcagcccagcaggtagagggagtcaaagggagagaggaatggggaattgcaggaagaaatattaagccatcgttcttgatagagaggaagagagagacagaaacacagagacggagagatacaaagccgaggaaagagacaaaaagggggagagaaagaaatttagagaaaaagatagttagaattcagagggaaaaataagagaaagcaagagtgtcagagaatgatgaaatgaaatgaatgatcttgaaaactaacaaaagaaagtaacgaagggaaaaagagagaaaaaagctgaaaatgaggaaagacagaaagagacatgggagataaaaagaaaatgaaaaagagacagattctaagaaacaaacaaaggaaaaagtcagatctactcagaccagagagtcagtgtgtacagccctgagagaccagctggcagaccagagatagggtgccaggctgaaagcagctcttacctgttgccctgcactgaggacgaacgaatgacaggtgggtacttgggttaggacctggcatttatcccttctcctctgactcagccccacccaccctgccttctgccggcctggccctgcattggccccaaaggtatctcagtcccttccttgctagagataaaacccaaagtagcccctccctctagtgtaccccctcccccagctctggctcttccctattttcttctctctataggacagtaaaattagctcatttgggctttggaatcagaccatccacatagagctgggataccttgagcaaaaccacctctctgactatagatctcctcaactataaaaggagggcaataaaacccagaagtgactgtggcacaagttgggagggctctggagtcagacctagaatacagtgttgtgcttatgagctcaaacagtcagcttccacagactagatccccggttgttgtaacaatttggtaatatcatgtatggaaaacgcataccacagtgcctggcccaaataaataacacctactgttgactgagtgcttacaatgcaccagacccttcactaagtgctttacatgaattaatttagccacataaggaccttaaaagataggtactattatccctatgttacagatgaagaaactgaggctcagagaggtgaggtaacttgttgataattacccaactagaaagtacagagcccgcctatgaacctaggcaatgtagttacagaacccacactcttctcttcctctcataatatacaattaaaaatgtgaagttctctgtcttatcttttctattaccttctcctccctttttcattttcttccccttttgtcactctctttttccccttcccttatcaatcctaaggcagcaggaccatgttataaccagacaatttcatctttagagcagattgtcatcattaatattatatttacataaataagaccatagtctacatattgatttgcaatttcttttttttgtttgtttttcattcaaccatatgccaatataccatggaggttacaaaatctgaatgcactgtaatttatttaaacactcccttattgatataaatttaggttattcccaaggattttcccccctccattatgattaatgttgcaatgaacatcttttggcatttgtgagagcatttttttagagggtggcatcctaaaatataagcattcctggatctaaaggtaatagacatttaaagtttttgatactgccaatttgtcctatacatgtgttatacacccctccccacc

SEQ ID NO: 137506 - DNA, 1527 bp, Homo sapiens
aaactcaccaataccatttgttattttcaatttttaaaatatttgttaatcttataggcactaaaaatggtatatcagtgttgctttgatttgcttttctttcattattaatgagattgggtgtcttttcatgtttctttatcagttgtctatttctcttctgagtggtctactttttgcccattttgggggtgggttggcagtaaaatatagtggactaaaagcatgcactctggagtcagactcacccaagtcaccaagtcaccaacaccttagctatttggttcacttatctccagatctctcatatataaaatgggacagtcatagaacctaccctattggattattgtgaggatgagatgagaagaactttgaataatattaatattaactccttttctgtgatatttgctgcttcatctggattaatttattaattcaacaaatgtttattgagtgcctatagcatgtcaggtgtggtgctaggtagtggagatgcagtggcatgtaaattggagagtatgggtatagcatggtgtatttaaccatttttaaaactaaagattaattccagttcttctagaaggtatttcaaatgcagctgcaataaccttgacctccaactctttagctggctaaccatttgtcactttgaaaagtgagctcaaaggtcatcacttctgggaggcccttttaaacccccacactggatcttgttccctcttctgggcccccacatcttctctctcagaatttatcacactgtactactggcaccttgtcttatgtcttcctcccacatcagaccttgagcaacttgctgacaggaatctggaaccattgactaggggggctgtcagaaatgcctgttgcattcagatgcatttcctccgttctttctactctgttctgcctgtacccagaaaaggaactggaagaataaaatctactgaggttaacaaacctctgaggtgacgtagagaaaaactcgaagtgccctaatggaggaaagtgtgtgggacttcccaggtcattgggaaggatacttaggtggtgcctctctgtactattcctggtccagctgagcccgtgagtgtaggtggctgtggttgtgcctgatatctcctctcctttagaggaaaatgtctcattttctctttgggtggtggttgtgtgattctcacctttttatgaggcaatgtagtctggagggagaagtaagtttcagtcccatatgctcatgtagcgtgtccaaaggaaacactttcctggcccttctctacatagtcccctctctctctctgcattgatttgttctgtgtcttggctgacttcctacccatgtgggaattcctctggaatcagagtctaggtctgattcatttctgcaaccccagtgtcaacctgacaataagtaactattcagacaatgtttgattgaatagacttcggtgacttaggagtttcaactttttactttgcagttgcactgcagtagacatcatggtacttaaagttttctct

SEQ ID NO: 137507 - DNA, 1102 bp, Homo sapiens
gggagttattaagtagtattaattcacatgatcacaaggtcccacaataggccagctgcaagccgaggagcaacgaagccagtctgagtcccaaagctgaagaacttggagtccaatgttcaagggcaggaagcatgcagcatgggagaaggatgtaggctgggaggctaagccagtctagccttttcatgtttttctgcctgctttatatttgctggcagccaattagatgatacccacccaggttaagggtgggtttgccttccccagcccacttactcaaatgttaatctcctttgggcaacaccctcacagacatacccaaaatcaatactttgcatccttcaatccaatcaagttgacactcgatattaaccatcacacctggcatatatcttaatacagctagtaactatttatagtttttgtcttttggtaaagaagaatgtgttttctttctcaatcccctattcagcaggcagagaaagcaatatgagcaaaaggaaaaaagtttaaaagtccctaaggtatttcaggaaacactacagagcacagatgatattttaaatgggttatgaagcatgagtttactggataaagcacagggaaaggggcaatccaggcagagggtacaatatcaacaaaatcagggaggtcttaagatgtttactgcatttcaggaacagtgagttttgtagatgttgagggaggaggaagagtctggaattacttgctccgtcactttatggaagatgagatctcatcctggtacttggttcttctaaatgttactgcaagaatgaacagtgattaagaacatcagccctcgagccagattaactgggttctgccatttattaactgtgtgaactttgggaggttatttcacctgtctgaatttcagtttccttgtctgtaatatgaagatactgataatatctactttatagtgtttttatgaagtgtaaaagagtgaatctgtttaaagtagttttttccaattctgtgaagaaagtcattggtagcttgatggggatggcattgaatctataaattaccttgggcagtatggccattttcacgatattgattcttcctaccc

SEQ ID NO: 137508 - DNA, 2432 bp, Homo sapiens
aaccaaggattagactacagcaatggagaatcttgaggcaagccagatagttgcagagagcccatctgagggacaaatatagggcttatcttagagttagatttctagaaagccccttaagatgggataagggtcacagagtgggcaattgtgggagggttcctggtggaggttggggattggagtgatggcctgggggtgatttaaagtaagaacacaatactggactgaagaagatggggaagggttccagcaagaaagcctcccttcagagtgcaatgtggaggcagcagctgcagtgcccgagagcctgagttttggaatacctgccactatggattctagaagtagtgccagatttcttccttgtagtagtgaatttcttccctgtcctcatttatttcaatagggtagaggcaggagaggaagaaaagatggagccttttgcctatgattaataataaaaccactgtattctagaaacagagagaggcaggatgaggtacaaagaaagatacctgttctgccgaagattctcagtctctggatctcttgtcaagataaccttatatttactcgcatatggctgaattgactagttagtaccaaattgatgcagagaggaaggaagacaagggggtaggagcatacacaggtgggattaattttactcaacttcaccaacagactttgttcatttctggtgggggatggctgtagtggtagagaaatagactgtggtgggaaaggggagaggggataaggtataacattttctggcccttcctcccccgttttgtgtttttccttttctctcctctcatgaccagaagtctagacaggaagcagaggtcggttaccagggaaactgaagctgagtatgcttgattcacgagcttgtgagataaaagcaaaattgctactcaaaatgcaagactgtatggaggatgggtattaaccaaataagcaaagatttattcatccttataattattgtacatagatatataaatccacaaagatgaatagcttttcctaaatgtttagttgagaatcagtctatggaatggccttgaatcctgcccctgccgccttccattctcactgctggccccatgctgtcagtctcccaacatgccttatgtctgagtatgatggagtcctaatgatattgcctctgtacgtggctctgtcagttacagggaaagaaactaagggaaaaaggaagcatcaattcacctagctttaaaagcaacagagagataaacctcaaccatcaaaatctttccctagaattccacctaaaaatcccagcaaatctaaccaaagtactggtctttcaatgtctaattaatatgtatttgttttgggtccagtatcaaagagttctacgaaaatgcaattagaatacatcaccattccttatacgctgctgcccctagtgtaacacatgtggattgcactctcttgacagttgtagccagttattccatttcactgctgtatgacgggttttagacttgtatctgtattttttaagatatgcagttgaatatttctgttaatctttttgattatagagaaatgaagcagatagcctaccactggccataatatttttctgatgggaaaatacattctgctctgtggcaactgctttctgatgcagtctctattgttgcattttaataaaaatcatcctctgcttgtatactcccatatgatttcagaatatttatgctgatgtcaactcggttgtaataattgatctccactgagaccttagaagttaatgtgaacctgcatttaaagtttaattagggagtaaaaagtgtcggggggtgttcatatctgtctgtactctcttctacaactggaaaactttccctaaaaaacaaaaaacttgtatttgagtagtggtgtgtgtgtgtgtgtgtttgtagatggggcataaaggtagagtgataagaattgacaagcaccaatatttattgagcactactaggtgtgatataatttgcattattttatctgagtattacatacaagcaataagttgggttttggtgcagtcattgaacctttcacctgccattttttaaattgtatgaggctaattccttgtggatagcagggtgaacagaaatgttattggtactgagatctttctgtcacttttagttgccatagccctttgtagtttagagaaacttctgataaggaaattaattctcacaggctaggcttgctttccatgcaatacttcgtttaacccttcctacaaacactttgatgtagatactattactatcttgaatttacagttgaggtacttggagatgagaagagcccaaacccaggtcttcctgtttctgaagactgtgtttttctgcctcccttatgtagtaaaaccggagaacagtctggagtgt

SEQ ID NO: 137509 - DNA, 1542 bp, Homo sapiens
agaaatataataccagcattgttaaatattgtaatttgaataagagtccttgccattaccttcttcttttgggaattgtaacattggaaggcaggaaattcttggaaacaactgtttacagggatccctgagtagcttctccaacataaaaaagacactgaatcatgttagtttaatgaaagaaaaagagatcttaagaggaaaatacacaccctattaaattcataagtatagaagaacaatgaatactagtcataaaatgctaataagtaacatataactttaactaaaagtatgtcaaatgcctttcaggatatgtatgtagcactgaattgatataggaagaccatacatgtccaccatcaggatatgtgaacaaaatcattgtttatttgtatctatgtgtgtatgcacgtatgtataaatgtgtgtgtcttatttgcttcattgtaacttttacccatagtccaacttacttgttatggtcattatttctactacatcctcagcattaattgatacttcaggtggaggatgagtacttacttctctgatgcagttattggaataaatcgtacaagcaagggtagagaatgtgtgaagggatttggaattgcaaggcctgtgtttgaatcctcaccctgccacttcgtagatatatgactttggacaaggcagtgatctgtttcctcatctgtaaaatgggggctgttaatcccaacttcattaaagggttattgtgaggatagaatgaactatcttaaatggctctactttgtaaaaaccattaagcccattatagagttttatgctgctattctccaagccaagtaggaaaaatgttgtaatagcataatagcaatcccctttctgtctttttccttccagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaa

SEQ ID NO: 137510 - DNA, 1021 bp, Homo sapiens
tatattgaaaattcagacaaaaaagaataagctttgtaactgtcagatagtataagcattctggtaagacatttgtatgaggattcaggaggatggtgaagatgttttatatattatgagcctttccaaatactaaagtgcttaaaatctcatttattctctgataaaagaatttgcactttgggaggctgaggcaggaggatcccttgagcccaggagttcaaggccacagtgagctgcaattgcatcacagcaatccagcctgggtgatggagcaagagcttgtctctaaaaaaataataaaataaagtgtattaaggttaatgcttctgtactaagatagcagtttcaagtgtcaaaaccatacaccatcaaaagcaaattttcctcttaatcattctgataaacggtccattaagtgggatctcacatgaaacagattcacaaggtaagtgtgacaaagcccaggttgcataatataggctatgtttattaaataaacagcattattagcctagaaaatgctagtgtatatgactttgtagatgctctttactaggctaaaggaggttaaaccctcttcccaaaatctcggttatggaatcacagtgctttttaagtctttgctttgaagtcagaagtaactgaatccataagcaggagattttacttggttttgtagtagcattctttagtttgcctacttaaaatgtttctttttcacaaaagaaatatatttgtagtggatgagttagaaagtgaagatacaggacgggcgcggtggctcatgcctgtaaccccagcactttgggaggccgaggcggacagatcacaaggtcaggagatcaagaccatcctggctaacatggtgaaaccccatctctactaaaaatacaaaaaaaaaaaaattagctgggcgtggcggcatgcgcctgtagtcccagctactcgggaggctgaggcaggagaatggcatgaacccgggaggcagagcttacagtgagctgagatcgcgccactg

SEQ ID NO: 137511 - DNA, 1369 bp, Homo sapiens
gcatacaagaaatatctcttcagtgtcgctacaccactggcataagaacttaagagtagacactggcagacacacatgtcttacgatcttattgaaggagttaaaaatcacttaccctggaattgtaacttcatggagtcaaaacaatgaaactaattaggtagattttgaaaacttagctattaaattcctcatattctttattttcaaggatcatttaaggttatgaaaattatttctagaaatgaaatgcacagcttggctttacttagagttcttgtattacatttttttatcttcatgcctggtaatggagtacttatatgacttttatatcttgggatagcagatagtgacattttttcagacaagttctcatatatgtatgttgtcacggctttacaatttaagcatccaaaagatcagttgtttcatgtaacaactctctctttacaatttattttcaggaaaagaagaagaaatggcagtaaagagggcaaccatcattccacccagcccaaaaggaataagagaaaccctatctttcaggattctcaagatacagaggtagcaagtatggtcagattgcctctatttcattcattgcctacactaaattatccaatttgtgctccataatgaaaagaaatgtattattccaagaaaccttcataaaagttttcttgcttgattacagtggcttttgagctggagctttaaattatgatatagtatctcacagaaaatggaaaagaagcacagaaaaactttgctaaacataatcaggaggaattagcccctgtaattttgtcccctcatatgagcagggaatagtagtcttacttcccttctttttatatggaaaacatattttctagtacatagtgatatgttattagctggaaggcaagtcttgctttctcagtgaaaaaaagtgaaaaatttggggcagtctcatgatttttgcaaaactttaatggtgctggaaaaagagtttgaagtttttaattttttattgatatagaatagttgtacatattttgggggtacatgtgatattttgatacctgtatataatgtgtaatgaccaaatcagggtaattgggctacccatcacctcaaacatacatcttttctttgtgttgggaacttataaatcttctcttctattttgaaatatacaataaattattgttaactgtaattttcctactgtactgttgaattctataacttattccttctatctaactgtattttataccccttagccaacttcttttcatccccccttcctctcttctaaacctctagtaaccaccattctaaggagcttgaattttaacttcaaggtgcttcactttaataa

SEQ ID NO: 137512 - DNA, 2008 bp, Homo sapiens
cacacttacttttagaaacaaatatttgtcttcttcacgtgtcttactcttcttttccatttccctctatctctgtttccttttttgccacactgttcatgatatatacttatttgatgttttgatgtcaaaaatagtgatagcttaacactaatgtggctatataattaattatgtaatcagaaatactttcctagtgaaaaaagagtcattgtggtaataaagttaatggcccctaagatagaagaaacacctgccaagtggagcaagaagatggtcagatccacagaggcttcttcatgtgctagatttcctgctaaagggggataaactgttcagctggttccagtgccagcttctactattgaggatgcaagtggaagcagaaaagatgggggaagaagtcagaaactcatattatttattcgggggaatgccatgttgggtgcaccaattatcagagggactaatcagttgctgaatcccccaattatgactggtattaccagaaagaagatcataatgaatgtgtgggcggtaacagtaacattgtagatctgatcatcccctagcagagttcctggttggcctaattctgcttgaattagaaggcttaaggcggtgcctagtatccctgcccatgtgctgaatagcaggtatagcgttcctatgtctttgtggttagttgaaaacaatcaacaattaatgaacataagtggggaaaaaaaggtaaaatggctgggtaagcattagactgtaaatctaaagacagaggccaaggccgctttttagcagccctgaggggatttctcatgttgaattgcaaattcaaaggagaagcttcagtcctgctggggcttcccccaccttttcccccaacggtggagaagtagattgaagccagttgattagggtgtttagctgttaacgaaattttcgtgggtttgaattccaccaatctagcaagggcttagcttaattaaggtggttgatttgcattcaattgatgcagaatagagtcttgcagtcctcaggtctgttacagaaattaagtgtaatcttcatgctttgaaggctcttggtcttatttaacctaaatttttaagttatagttagtattaatggagagataggtaagaggagggtagaagagataagtggggggaagaatggtatgggttttgtgtttttgaattgtcattttattttcatattattagacgtggggaataatgtcactgaggtggaataaattaggcgtatgtaaaagtacaggttgagtagggttatgatagctataatgtttcagcaataaggctcttgttttttgtaaattcttggatgatgattcatttaggcaggaaccctgttaatggaggtaaacctcctagagatagtagaattagtggaattataggtgtcaaccatgttaatttgtttcaggtgtgtaatagtgacagcgttgtggtgcttatactcaggttgagtgttaaaaatatggttattgttaagataaaataaataggtttagaatggtaatgtttgggctatagagtagtgctgctattattcagcctatgtgagtgattgaggagtaggctaagattttacacaattgtgcttggttaagccctcctcagctgcctactataatggatagaattgtgatagacaggaggatgttcatgtttgttgatgggaaaatttaaaacataatcgatgtttcttcacaatatcatgtgaggagaagtataccaggtattagagaggttccttgggttacctctgggactcagaattgaaagggggctattcctagttttattactagggtcactattattaatgatgaaaattgattaatagtgtttattattgttcattgtccagaggacaggttgttgaaaaggatacctattatgagaattacagatgtggttgcttgcgtaaggaaatatttggttgctgcttttgtacagctgtagagtggggacttatatttttaatt

SEQ ID NO: 137513 - DNA, 1360 bp, Homo sapiens
taaatgaaccacttatcagtaaaactgataacaggataatggctagggtgacctcatttgaaattgtctgggccacagctcgtgatgcgccaattagtgcatattttgaattagatgctcatcctgatcatagaataaatggctaggattgatatggctagtataaataggaggcctatgttaaaattaattagaggatttggtatagggaggggagttcataagaggagatcgataggaagggctaggattggagcaataatataaagggtaatagtagatgttgagggctgtaagggttctttggtgaaaagttttattgcgttagcgaatggttgaagcagcccgtagggacctacaatgttaggtcctttgcgtagttgtatgtagcctaagatttttcattcgatgagtgtaaggaatgctatagcgatgaaagtagggataataagtaggagaaggttaattataggtatattgttaatgagaggagttgaacctctgattataaagttttaagtcttatgcaattgccgggctctgccatcttaacaaaccctgttcttgggtagggtatgtgatgatttgttagattgagatagcatcatctgtggagcgagggcactttatgaagtgggccctatttctcttgtcctttcatactaggggaaatgttaaatagatagaaaccgacctggattactctggtctgaactcacatcacgtaggactttaattgttgaacaaacgaacccctaatagcggtgacaccattaggatgtcctgatccaacatcgagattgtaaaccctattgttgatatggactctagaataggattgcgctgttatccctagggtaacttactccgttgatcaaattatcgggtcaatatatattaacttgcttaggctagtgcagtcttagtttaggttgctcggaggttgaattatgctctgaggtcaccccaaccaaaaattttaatgcagggatagtaggctagggcctgtaggcttaagtttttatttgcattaataaattaaagctccatacatagggtcttctcgtcttatttgtttatatccgcctcttcgcggataggtcaatttccctgattaaaagtaggagacagctgaaccctcgtgtggtcattcatacaagttcctatttaaggaacaagtgattatgctacctttgcacagtcaggatactgcggccattgaacgtatgtcactgggcaggcagtgcctctaatactggtaatgctagaggtgatgtttttggtaaacaggcggggtaaaatttgcggagttccttttactttttgtattctttccttagagcatacctgtgttgggtta

SEQ ID NO: 137514 - DNA, 1050 bp, Homo sapiens
cctcccgccacccctggcctcccaacccccaacacacacacagcccgtcgtcagtgggaatggagccgacgcactccttccctagaccgtcgagccaatcttggaatgtttgtagtaggctgaaaatacagaaactttaagctatttttttctcttctgcaaactccaggcccctccaatctctagctgtcatttctgcccttgtcccacccctgtcgctgcctgccccttttcctatctgctagcggaagtccctgtggaggaccagcctacttcctctttggtgctaggagtgtgcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttct

SEQ ID NO: 137515 - DNA, 1048 bp, Homo sapiens
gagaccattgccacagcaaatgtgcactgagcacccacattgaagtctcaactctgagttgcaaccaaatctcatatggatccacaatatttgaaagaggaaaaaaaaggttcactaagaaaggaacacacaggttgtatacacgtatcagcagaatccagagcatagcactcaaactggggacctccccccgaccgccgctgcaaagcctctctactatcgcttatgtcacaccccttcctccaatccccagacatgattttataaaaggagacggaggtgtccatagatcttagaattgactcaatgattgcttgaaagagagtagccagactggaagaggctgaagaatgtttaattcattggagaaatgtaactggtcacccctgctcacctgtagtaaccattggattgtgtactcagaaagtaggattatttatggaaagcaaacaagtttctttgtatttccacaacaacctataccgtatgctgtattaaattttgagctcctgttagcaagatagtttgtatccatgtggctccctttcaatttatggtgtccatatccctctagtggtttagaacttcacctaaaaacggacgtatctcatattagcattttggaccagcccgcagataatggaaggcaatgccatctaatgtttaaaagcaaagtgtgtattttggacttggagagaccagtttcagatcctacttctgccgcttaacaggagtctcacatggcaatgtgtaagctacctaacttctctgattcccagtttactcatctggaaaaaggaggactatgattcctgtcgcttagggttgtggtgaggctgagatgaatgatatgactatatacccaggacaaaataggtgctcaatatatatataagctatggataagattcacattcttgctccattctggaatctgcccccaggatcaggggagggttctgtatcacctccagagcaacctagcacagcgttttccagctgtgctaccacagaatgtagccctggctttaggatcattttacgcacc

SEQ ID NO: 137516 - DNA, 2411 bp, Homo sapiens
agcataatgaaatgaaaagaatgctttaggtggggacaacgggagtagaagtgttctgatgctactctatgtcatttgtttttacagaaatatcttgtgaagtcagggagtattcctttatcagcaaaaacttcacaattggtgttccagctgtggctgaccagctaaatagtttgaaagaaaaataatattttaaaataaagtttaaagagctttaaaagaaaaacatttaaaaaggaaaaaatcatttttaagattttaaaagaaaaaaacttttaaatgttgaaaaaaatttaagttgttatttttaaaagaaatattttaaaagttaaaaataattttttaatttaaagaagtttcagaattttaaaaattaaaagcaaagaaaattaaattcttaaagtttaaaaatgtaaaataaattaaggaacaaggttaaaaatgaaagtttaccaaaaaaaggaagaaaatactgttaaaaattaaagttagaaacaaaggaacatcttaaaagtttcaaatgaaggaaaataatataaatagatatttcaaaattaaagcataaaatatacgtatttaaaaagtgttaacaaaattactactataatgattaagaaataaattttcaaaaatacagaatggaatgcaattcagattttagagaaaagttttaaaagaggcaagtttagaataattcaagacaaaaagacaaaatgtgtttaaagacaaaaattgaaaaaatacaggaagaaaatagagacttgtaaaataaaaagaaccttagataagttcaagagatttaaatgaaaactttaaatatttaaataaagatttaaaaatttaagcttttaaaaagaaaaacagttacataaaaattgaccagtgaaaaaatgtgaaagattcaagtagaaaaaattattaaaattaaaagtttaagaagttctatttttttatttaagcatattaaaatacagacgggtatgaaagaaataaatggaggagacaggaataacgacagcggtgtgtgagtatatatatatatatatatttttttttttgagctttatgttgatatatcaatatacgttggaaaaggaaatagacattttaatcattatcttaccatccaattgtgaaatggctgcaaggcctaaacactaactaacccaccttcccctcttgagattccatgccccatctcatatcctgaaggaagtcaaattacttcctaggcagaatcaattcatctgagaaaaatgaaaacattagggactttcccatttagaactgcattattcatacaaattcttagcttctgaaaaggggctcttgataatttggtggcttagagaagttagatcacagctgtgaagctctggctttggtatttgagccccatggcctgattgaggaagtggcagggacccatatctgaggccttcccaccttcctttttccctcttccccctccaaggagaaacaagacctttaatttccacagtagagcaatgggtttgtgcttgcagtccttctgctcattctttattccctctttatttcctttttttgtcactcatgcctagttccctgaaccccttacttacctggccttacctacatctctgagccccagcctgcagggctccttctttgactattcacctggtggcttttactcctccttcaagacccaactcacagatgacttctctggagtcttccctgaatgctctaggcaggtataaatgagaaaattgttcctctcttcccctctttattcctctcactgtgcctccaaagtactttgtccatacctcggtgatagtacttattctactgtgattttattgtagctttgtgattgtctgcccctctgcactgagcatctaagaacagggggccaagccttattcatttctgtgttaataaatatttgttaaatgtgaagatgagttcagttatttgctctattcaccttgtcagtaatgttttctcaccccttcatccatcaggctgccattaaatgcccagtgctatactacagtgtgatcagtattgtattttaccccaaagcaggatatgaaaagcactcagctgcaggggctggcttaagaaaggtgctcagtgagaaatagccaggtgtgtggagggaggcccaggtacaatgcagagaaaagagcacaggcctggaagttggcagtcatggaagactgggtggggatgaggagcagcagctgaaggtgaggctgagctctctggcatgtgtgtggccacactgcccctcatcacagtgttcctcagcagcagtgtctcacaactgtgtaccacacctctctagggtttaccacattagtttaccttccccgtgagacagtagtacctcatcactgcacagtgttcttcatcacact

SEQ ID NO: 137517 - DNA, 1410 bp, Homo sapiens
aagagcgtgagcccgcgccggaggagaacttgacgtggagcagcagcggcggcgacgagaaggtgctcccttcaatcccccttcgctgtcacagcagctcctcgcccgtttgcccgcgccgcaagccccgccctcggccccagccccgggcccgctcccgcagccagcctgggctctcggccccacccccgcctccagcccggcccccgcccccgccgccacccccgcccccacccgcaccgcggcccagggcctggcgtggatcccggcgcagatcccggcctgggtccaggcctcagacacggagaagctgctctggtgacctagacgggtcgggggatcctggcggcttaggggactggttgctggaggtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgccaaagaaacaaaagaaaaaattttgagattattaacttccacctcaacagatgtttctcatcaacagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaagatgatagtggtgggcaggaggccaataaccccaactgctgtaactgcatcatagaccaaatctttacaggtggcctgcaatcagatgtcacatgtcaagcctgccatagtgtttctaccaccatagacccatgctgggacatcagtttggacttgcctggctcttgtgccacattcgattcccagaacccagaga

SEQ ID NO: 137518 - DNA, 1048 bp, Homo sapiens
gatttgcgcctgatcccacatgacttagtatagcatgggccatcgtgccaggtaccaatccggacttactccattgcccctttgcccccttggacacacacacttttaaacaatgtgtgcaccctaacgaaccatagttcctgagagaagtgcaaggttacctttcggagatgccacaggtggagccttttctctggctcatccagtatctcagaagttctgcttttttatagccttttctcgaattatttcagggttgttattattaaccatttttattgtcattagtttaaagtcagccacaacacccaccctttgagggtctgccccgctcacttcttcccttgcctcattccttgttctccactttccccttcatataaccttaacagttcggtgaagagtttatttccaaatgtccacgctaccttcagtgcctccatttttactccctccccttcttctctattatttccaaacctcagattgtcccctcaccaagattttctgacggtctcatctttttttatttctgaagtaccccatgacaaccttttcccctgcaaccaccccttctctctgccctcctcctctcaagatgatttttgtgtattttctacttccgtggcaggcaccctgtgatgtcctcttctttttgccagtgctccctcccctatgctgggtggagtatccaatcaaatatctaatacataatattttcatcatatattctgatcgtatatttcagtcccccccaaacttatttaagtgtctcttgaattttcacacatcctatggtgctcccttccccggcccactccccaagacaggtcacataaggttttttacattttcatggcacttcaggctcattctctatcccagcatttactgcactgccagtttacctatttttctttcccacataatctagaacattctttggacctggaggatgtgtactagggagtatccctagaatctagactggtgcctcacataacaggtggtcagaaaatgcgcaagacgtactagttgttaggctttt

SEQ ID NO: 137519 - DNA, 14292 bp, Homo sapiens
ggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgaagggtatttgtgaaacctggaagtgggggtgttcaaattgaagagagtattgtgaattagaacacttctccccaccccgcaccatgataaattgctttgatttaccagtaatgttgattgggattatgctttggacgacaggataaactggaaagcgaattggtgctaactgatcagaaacaacccttgggaaggggctgatattcctggtggtggtgctgggggagtgttctaattaaagcagttatgagttgctttgaattatcagtaaaggagatttgctgtcaccaggttggggatggaaagactagaaagaagatttgcatttccaggtcagagcttgagggtgttttctgtgccaatttgtacctgaatttgagacttacatctactttgtgtctgtgatgagtgaaatagggcttggaaggacagctgaaggactaaaaagatacttccagattttaaaattaggaggctgaatgttttttatacatagaagatattcaatactcagtcctcaagtagaggatatcaatatattctgtttttttagaaatagaagatattgtttgattaaagcagctgtgttgctttgattaagatgatgaaaaattgaatcttgaattttaatggctcatttgtattcctaaataaatcttcctaggagttctctcttgaacttctaattaggagatagagagtatacacacagttttataatttaggaaaatgggacctctattcatctgaggtcccacacacacagctgtactcagccgttgtactaaacatgctcttttgtacctccatgtttatttatacttcattaatttcaatttctaagggaattggatcatggaaactgttttttggtttatatctgcaggtgggtgctaccaaatacagccatgaagaaaaaggtaagacgtgttagatacgtcaaaaccatgaaggtaaaggtaagaagttgatattcaggaactttgtgacatatatacaccatcttttctggactattgcaggagccttctgtgtggtctgtctgactctcttctccttgtatgctatcagatttaatttttctaatatgaaaatccgactgagtcatctacatacttaagaacctttagtaacttctttaagcccatggaataaaatccaaatgatttcatggccctttaaaatctgttcctgaccaaaccctgtgccacacttatgcaccctatcacagccctacagaatttattgttctccagatttacaaattaatttgcactttgtgtaagccatatacacacaccatacaggcctctgtctgcacatttatttttaacctaactcaagtgttaccactataaggtcttattgagttcttcagatagaattggacacaccttcctttgtgctctcatagtactgtgccctacgttggggtttaggcagaattgctaagagtgcagctcaagctaatttcttaaccttttggggcttcagtttcctcatttgtaaaatggtagtaataatattaactgtatcgtaagattgttgtgacgtttaaattagtaaatgcctgtagaacacttagatcagtacctaacatgattagccttggtaagtctttcataggcaattgaaagaggtacactgtataaattaataaccgaaggaaatgtaccatatttagccttagcttcatctaataattcagttctgtaactacagtttgctaagagaatgttcttgatgagcctgtctgaagttgctttcattgagaatgcctaaaagtacagaaatttctacatgattaagaacaaaaattagcttgatttaatcattctgcattgtatacatatatcaaacattgcattgtacctcctaaatataaagagttattgtttttcaattaaaattttaaagtacaaaagcaaactttttgtagcaactttagactggctcagcagtggcatttccttagtgagataaagttatatagctacatttttagattaaatcaagtctgagtgtagtatattttcatcaatacttcttatattagtaattagaaatttgtataaaatatcttgggattgaaggtagaacataggttcccttcatttgaaaagcaagttaaggctgggcacggtggctcatgcctgtaatcccagcactgtgggaggctgaggcaggtgcatcacttgaggccaggagttcaagatcagcctggccaacatggcaaaaccctgtctgtactaaatataccaaaaaaaaaaaaaaaatagccggacatgatggtgcatgcctgtaatcccaggcatgggatggctgaggtggggggctcaggtggggtggctgaggcatgagaatcacttgaacccgggaggcggaggttgcagtgagctgagatcatgccacagccctccagcctggatgatagagtgagacttggtctcaaaaaaaataaaataaaaaagaaagaacgaaaaggaaagcaaggtaattggaactatatttcataaattctagatttgaaaggactctcaaaagtcactttactaaattcccttttagtacgagagtatagaacatcattgacgagtgctctctgtgtgacatgctgacattgacaggaaggctgcttaccttcatgaggctaccttttcccttggacagttctcactgtcagatactctcttgctttctatatttgttttgataacttgcttgttcttttgatgtacatactttgagcatctgttgtatgttaggcactggaggtatgaggggactttctctccccttccagagcacagagtcttctgagagagaaggacagaccccccaaaataagtaactgcaatgcattatagtctttgcaatgaaataacagtgccatgggaggacagaggtaagacacttaagtcagcctagagcattagactcagaatatcttcttgcaaaaatgattactgaaccaagtcttgaaggataactgcaatttagctgaaggaagaaaagagaatggatagtttactggcagagagtactgcgtgaaacaatggcacagatgcaggacctcccagacggctgggaacaatcagagggactaccagcagttcaattaagtgtggctgtaagctaaaagtttcaggccaggagggacaggagatgagggatgagaagtaaatagactagatcaaggagggtcttatatgtagtctaaggacttcatcctgcaggccatgggaagcttttgaaaagaaaaaggagggacagtaataaatggaataagagcatagaggtaagtagaagggatgagatcaaaggcagaggtggaaagattgaccttgatcagaaggaggaagaactttcagttatgttgcaatcctctactaggtaattcagttaacaaaacattgggttatgatagaacagggtttagtttcctctaaacttggtatttttctaacctgtttctgaacatattaatggtgcatcttaatagcataaattcagtgtaattctgtcacctaaaggatgtatgtcctgtgacaggtaagtacctggctcctggaattctaagtatctctgcattcacccttcgttgggaagagtttagttagttgtgagtatgcgcaccaggttgttggtactgtcagttcaggaaaatatcaaatccaggagagaaatagatccctttagacttgatttgctctagattgctaacttttttcctttccttttccctactttgtccttaggtgctgttgatgggtaaaagtgggtctggtaagaccagcatgaggtctattatctttgcaaattatattgccagagacacacgtcgccttggcgcaacaagtaagatgttttatcttattgtaaagtcaggtgatcttaactattaataatctgcataacacacttggtttcagtaccttggggatgcagagaggttggggaatttgttatggagcatgtttaccctttttgcattcgttttcaaagaggtgtggcctaataccagttactactgcttgctgtcttgggggaggttcttttctttctaggttgtttatgaagtggattgcccttgtccaactttttgtttattctgctatttcttaaacaagcattgtttgttcgtcttgtggggagagtgtttttaactcttatacaaagggaaatccataggtattaacaagcataacagtaaaatatgctaagattttttaaagcagtagttacaccttgtcttcgttgaaaggtaaattacggtggtgggaaggaaagaagttaacttgatctgtactctgctacttcttttcctggatacacatagatgatctcattagagttttggttctgacttagggaatatgttgttgccttttatagtttgagtgttagtatatactaattgggctgccatggacagtgaatgtaggatcctgggagagcccttctgtctctgggttgtactgccatttcattctgcagcattcaagcatttctggattctgcttggtccttgatttttagggaaaggccacccactactctacacatttcctgaagtttcaagaacaacattttaaaaacacagtatgtttcagaccctaggaaataaaggagaaggaaacctcatttctgttattatcgtgcttggagtgtaagtgtagactctcataattggggcagctttgttgtctagaaagctgtttcttgaatgtatatatatgtattttttgagatggagtcttgcgctctgttgcccattttggagtgcagtggtgcagtcttatctcctgggttcaagtgattcttgtgcctcagcctcacgagtagctggaattacaggcacccacaacgacgcccagctaatttttgtatttttaccagagatgaggtttcaccatgttggccaggctgatctctaactcctgacctcaagtgatctgcccgcctcggcttctcaaagtgctgggattacaggtgtgagccaccgtgcctggcctatttctttttttttttttctgttagcttgttctctttctgttctcttaagcctctacaaatatttgaggatagtcagtgtctcagtttgtcctagcgatctcttgcctcacaaatcttttttttttctttttggagacggagtcttgctctgtcatccaggctggagtgcagtggcatgatctcagctcactgcagcctccacctcctggttcaagggattctcctggctcagcctcccaagtagctgggactacaggtgtgtaccaccacatccagctaattttttttatttttagtagagatggagtttcaccatgttggccaaactggcctcgaactcctgacctcaggtgatccgcctgcctcggcctcccaaagtactgggactgcaggtatgagccaccatgcccggccatcttgcctcacaaatcatgtcttccttaagttaaaaatgtccagctcttccatctatttctcatttgacatattttgaaacatttttggggacttgttcaaacttgtttacatttttcttatggtattgagagttagatgcaggtggagtctgatcagggcagagtgggcctatcacatctcttattcaggacattacattgctgttagcacagtctaacatgtatcctccttttttggagtaactttcgttatgaggagacttactaaaaaactctttcaaatagttcaaattccctttcagatatgttgttattaaaacacatacccttctggctcttgtgcagttaatattttgaaccaaagaataaatgcttacttctattaaatcatttagttttgtttgttttagcccatgatatgttcctgtaccctttgtttgttaactgtgaaatccagaacaagtccaatccctttttcctcatccataaaaaaagggattggatcctattttcattttagctacttattctcttatctgatatattagttatctttcctaactctaatatctgatacattagctatctttcctaactccatggagtttgtacatttgatgaatatctcatctagttttcatctaagtcattgaccaaaagttttggtcaggatagtgtcctatggcctgtcatgcctctataattgacatctgtagctctggcctctggaatgtctacctgtccaaacttctctctgcttgatttgatagattaaaactttttttttctttcaagttaaatatctgggcctaattacccttatgatttcagtagattagaggaagctaatggttattgaacaactgttatttgtcagacttttgtttactgttttatttactttagttctcatgttaacttcatttttatagagaataaagaaggaggtacaacttagaaattaatattactcagctaggaagtatcagagctggaatgtcaatctatgctcttgctttattccttatgccacattctatctagcttaccctctgctaacgattcctggcagacttatttttatttctgttttaaattctgaacacttttgttgaagcatctttttctagtccaattgctgttgctgtttttatatagctgatcagagttgacttattaccctgaatccagagaacagtcttgcaaccagcatttcagagttattcaaactgcttgaaatagttttgacataacctagcagccttattgtgaacagaattttgcaaattatatgaaccccatacattaaggcaaaccatttattcagcaagtacttttctgaaactttttatgtagcaggcacagagaacgggacagagctcttgcccttaagaatatctcaagcaggacctttattactaatactttgttagtaatcactgtatctccttacaggtagtgaaagtatactttaaaatattatgttggtcttaaggctttaggatatcatcattagctagtttgtcattgctaaagaaatacctgcgttctattgctaaacttatagacaagttcaaaatgcatatatagtgctctgctttttatttgatagtcctctttatgtagttgctgattttctttaaaagtagtaagagtacttttaaaatattgcattgattttaatgttttagtgtttttctagtttctcattgctgaaaatagtccagttttattttgttaaacttagagcctgctgtgttttgaaatttgaagtaagaatacatgatggtgatattattaacttattagggggctgctaaaatgtatttgttggaacagtaaacttgtcaataaaaatgattatgaagtattttagtctcaaacactgttgacggctccaagatttcctaccttctcaaaattctctgttcccttggcttttatttaatgctctattaccctggttttcttccattatctttaattatcccatccctctttaaaaaaaaatctttatcatagtattttcttctttctgccccgtaagtgtgtgtcattccccaaagctctgttcttggttctttttagttgttcttgtgataatagggtaggaagactaggagagctagagatccatatatggaagacatgagactaaagagggaagcaggaagtgggtggttagatcataaaatgtcttgtaagccaagttagatagtaggaactgagggtaaagagagttttaaacagaagagcgatattttacaggtcccagggattaaggaaaatgttaaaaaaaaaaagaaaagcaacatgagctgatttatattttattgtttttaattttcagttttaattacaaaagtagtacttgtgaaaaattcaaacattacagacgtgtaaaaagcctcttttctccctcactctcaggcctgcttcctagggacaaccacaattagtagttttgaggttatccttctggccctttcttttctgggtgtatacaatcgtgcatatgcggagagacatggtttttttctgtttaaagaagaataaaaatctgcattttggagagagatcactctgtctgtaatatggaggatagattggagggagggaaggctagaaacaggttggtaagttaggaaactattttaatagaccaggtgagagatgatgggggcttgatttgggctagggtgatgatagtggatatggtgagaagcaaatggatttgagatctatttaagagatagagtcagccggactttctggtagatttggggagaatgatgaggaaaaaagtggactgaaggatgaaactgaggttttggcttaggcaactggttgaattcactaagataagactgaaagaggaatagattttgtaggaagaaagggggagatgatgagttacatatacttggatacgttgagttttggatacttgtggttcattcaaatggagatttgtaatatatgtcagaaaggtagagaaatctgttctagagatacctgtttctgagtcgtcagtgtccaaatggcaaataaaataataagaatagactagcttgccttggggaaggtggccaaggatggagtcctgaagagctccaacatttaagggacagaaagaagaataggaattgtaagggaggatctgccagagaagttgtaggtatgatatcagagaccaagagaagagaattttttgagaagagagtagtcaacagtgtcatgctgcagaaagtaagacaaggactaaaaagtccactggatttggttatggggccattggtcacttgatgagaataatttctatgatatgggagtagaaacctgatttctatcccatgtgccccatgtctaaacagtcactgactcctgtcacttcttttgttattgtctttccctttctcagtagcacttctttccatttttttttagtactagaccgtatacatagtcttcaaattaatagcagtttgagcacctactctctcgtagactctgttggaaatacaaagacatgtaagatatgattccttttccaaggagggggaagtaaaggggagaagggaagtagtttgagcacctactatgtgccaggcactttatgtatgataattcattgaatcctcatagtaatcctgtgaggtcagtgctatgccccgcccccccgctttcttttttaatagaagcggaaactaatacccagagcttaagtgacttgcccaaggtcacatagagaggtagagctgatatttgaatgaagatttgttcgattccaaagcctgtgctttttaaaataatgctctgctgcttgtgatgtagtttataagaagataaaattgcacaaaagttagatagcagtcaatttaagcaacagctttgagatagtcataggagagatatcactgtgtgattgattatcacaaattgtatagatgataattcctagactttgataaattttcaggataaaatctttcattattactccttggggtttttagtgcctggcagagagtagatgcttaatgagtgtttgaatgaattcagagggagagatgatggtaagtaggggtagctaggcagggcttttagaggaggtgggatttaggctggctcttaaaagatgaatatattttgaaagaaagatggggagggatttccaggcagatgaacagagtaggtgaagaatagaggggagggaagtgtaactcagaggtcgcaaacaggcagcctatatcctggataaggcctgtagatgtgttttgtttggcccatgtgatgttttctaaaaatgggaattagttatcagcatgtaaaagttttcataaaaatatggatttcccactactgctgaaaaacttaaagatctggtaacccagagtccccattcctgcatggcaaatgaaccagagctgagtaactgctgctcactctactatctcattgggtagatgtttacactccatatgtggccaactttgctcatgtacggttactggcctggcccctgttagcaagtttgcgacccctggtgtaaagtattttgggggttggggaggcagtggggtttgggaggactgtgaataaaccaaattgggctggagtgaaaggctttattaatgtggatcattggggaatgtataggtagattggaagccaaattgtgaaggaccttgaatgcctccccataggcatggaggagccattgaaagtgttttgaatggggagtgacatgttcaaagtagtgttaagaagatgagcctggcagtagcctgtcggatgaagtaaaattgagtaaggctttttggtggggaggtgagttatggagctattgtagtagtgtagacatgagatgataaggggcttccttaatgtttgtggtaggttataaaataaggaatggatttgagagagattacaaaggattagcaatgtattgaatgtggatagaggagtcaaaagtgggaaaaagttagggtcattaactggaaaggaaatcaatagcaggagttcatttggttattgttttatgtttgttttttgttacttttttttttaatttttgtgtgtatgtgaggttggtgggggcaagtgggacagggaagactgattatatggtatatatctattacatgttgaaattttaacagtattatagttggagattgtttctgctctaagtattaaactactaaaaagtgaaatgacttaacatgagagccagttctatagcccagggtagtttaggtgcctaccttgccactaaaccacactactcagctgaaaatcaccttcttgttgtggctttgagcatttcactccactttggtccttctaaatttcatgggttagtgctttgcttattttgaatttcacttcacctgttataattactagatttgtcatatttgtcttccagttgatgtagaacattctcatgttcgatttctgggaaacctggtattgaacctgtgggattgtggtgggtaagtaccatctgcttacttgtttgtgaagccgatgtcagtaatcgtggcatctagtatatcagcatggcgaatacacctagagtaactatcatttgtaatagattggatagaattactttaaaattgacacttgagtcaataaacatctctgacttttatggaattgtgaaaatgccctctgtatgtgacatgtttaaatagcgctaatccaagctccatctaggtatctgtagtttgggatagattatcccctttcgtggaggaataaattaggtttctgtctcaggcagcctgacaccagtgctgagctcttagctgtcacaccatactactttgttcttagttataatacgtcaataattttctccaggcagtctcaatactgtagatcagacactgagcacacattctctagctaagttacctactttttggaagagtaggagttagctcttcctcttatgagcaaaatattcaccacatattccatcacaaatgtacacacactgtggatgtatgctggctatggtgcatctctgtgctgaaggaacagtgtgcactgcacagtggataggagcataggttttggagtcagattggggtttgtacctcagctctgttagctgtgttatcttgggtaaatcatttaaactctctgagccacagtttcttcatctgtacagtagtgaaggcaatggtaccagctcatagggttgttttgatgattaagtaagataatttatacaaagttgcatagcagagtgcctcacaaaatacatagatattgttagctcagtgtatctcgctcttagcatagagccagccatagagtgggtgctcagtgaatatttgttgaaagaataatgcaatagctaaatactctttaagaaaatgactccattcctgctagcagatggatcacttaacatcctagcacatatctccatacaaatccttcctcattatcattggttctaattttctaatctgtgttaagacattagtcccaagtcccttgcttttaggcactaagatgtgatgatcttcatttttagagataaggcaactgaggtccagggagattatcattctgctgagttcacacagctaattaatagcaaagtgcaggactagaacctaggttcctgatttttttctcctactaccggatgctactgttttctgctggccaagtggtaattgagaacttcctggaaagcagcacttagcctaacgagcaaagagcaacattctgttaaaaagttaccattggagtcattttaatgtagtttagaatatttgactattgagttattcattcagcaaattttcattgagtacttaacactccattagaagctgggaaacaatgaaggatagtaacagacatggaacttgctgtctagggaagtgaatggtgttaatgaaaaactcacaaacaagtgtaataacttgtggtaaatgttagaagtaagaggaatgtattgatataagagcctatgcttagtggattgacctgtcaggaggccatgggtagtttctgtgaggaaatatggattgaactgaaatctaaagagacaagcaggagttaactagatgaggaggtggggggtagcatctgagacagagtgaacagcatgtgtaaaggccacatagtggataaaccatgtgccacttgaggaattgagaaaaagtcagtgtgtttagaacataaggagaggggcagagaaatggatctggtacaggagaatcaatgagaccgggtaagaaacagaaaaggggctgcaccaaatgattgacacgctctgcaaacttcttttgttggctcaagttgtggctcaagaggtgagaaggtaaggccagacttatttgttatgatttgccctttaaattgaagccttaagattatctttcacattgatcaagccaacaaaaataggctataagtaggagtgattgaattgaggatttgcttactatatatatattttttctatcaggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctggtaagaaacagaagaagtgctgcaccaaatgctcgacatgctttgcaaacttattttgtagaggtataggtaaatttgtaccattttttcaggaataaaaagtcagcagaagttttgaaagtaaagttttgtcatttactttaactaaacactcttttaaacacattttcaataagggaaagatttattagtaaataattttcagaattaggcaaggattctgtccaagtgatctcactaagcagcatttatttatttttaaaatatatttgctgccccagttttattgtccttcaaagcagggagatagtgtcaaggttaagacccactaggagtgagatgaagagaggttgctgctttcattagattgacttaggaaactggtatgcaccagttcaagtgctaaccacagtgtgttaggcactatgccaggtccctcataatttcactgatttactagatttctcttttctgacatgggagttagtacacacaaatttaaaccagagaaggcaca

SEQ ID NO: 137520 - DNA, 1951 bp, Homo sapiens
ttggttaccattttcctaggtagaggtcattctaatgggttccacctggcttttccaccacaacagcctgcactccacaggtcaagagaccaatgagggattctgccagttgttgagcatgtctgtttcaattttgtactctggaacagggaaaataacccacaagaaggttgcaaggacccactgggcctacatgagacagacctgagctaaaactccattgattacttaacctttataaggccctactttgactggtggaccacagttacattttaggtctcactggaattagggtcatttcagagctaatgctcagtagtagattatttccttttctgtaacgcacagtcaccctgctaaaaggccacataggtccatttggaggaggctgggaggaagattaacagtataaatacttggcagtgtccttcctcaaggggacccaggctccccttcattcaaggggtctggttttgtaaactggtacaagtctgggtattgattgagaagccgtgagtctccaatttaataattcaaattaaattttttatcacttgacctagaattcttccacatatacagatcaagtaaaaaattagtagacttcccatccatttcacttctaggaacatcatgataactagccaacaccataggtctctacgagtcagactattctgattaatgctttgactctgcttcagttatggtactatgaccaccttgtctttggtgattaagtgcccccacttggttcctgccattctaggatccaactactcccgtcgcatttaggtttcccaattcagtggcagcagttcccactgaaagttctagcctacagagaagaatgatcacataattgaggaaagaagctggggctgcccttacaaatttatttttcatagtcatgatgaaagaaaggtgtgtcttctggaacctcgcaggtttggtgagtaggccttaaatgaatctgttaatacttgaacattacaatgtccctaaagcctctttttctatggatctcttcttctagagtataccaaggcagttctggcatttcaacttcatgtcgtttaggccaccttttggtccatgtttcatccaaccatccaaacaaactgttaaaagctctttcttaccccatgggctgcaacattaagtgtggaacctctgcttaatgagctcctatcggtaaatttagcctgatccaactttatattttttccactattatcctatacctttaatatctattcccatacatatttccttggtttttgtctgtaaattggagaaattatgtagttctttggagtatagcataattcctcatgggtcatacttcacacgtcacctttaggagtctgctgagacttgaactagttataggtgtagaagcaaagaggggtagtgggagtgaatcaggagtgtcttgcatggcagatacctcagaggagaccattgcagttttctcaggccaaatagagttaatatcagatatggatggagtggctgcttctactggcaaagaagactgagaatttaaggtttcaattttgccagcttcatcaggatcttcccaaataacctccattccaaattttagaatcctacttcttcttggccaatgccctcactttattagcagatgccctgtgaggttgtgaattcagttcgcattgtaattcatccacttaaaggatgagattctgaatttggtttcatcagtctcagctctgcagctatagggggtaagagttttttttcagggcagtcatagaaactttgtggtcgtttataaagtatttatactgataattcagatctctgagctcatcctttctctactttgttcagcacaattaggatcagccagccaatctcatatttgttattttgacaaaaatgttcgaaattatgtatgtggtcacgtggtaccttgcct

SEQ ID NO: 137521 - DNA, 1318 bp, Homo sapiens
gttaattttgtggttcgggtcagaaagcaatctggaggcaaaattcttttttcttggggaaatgacaggctttttctcttaaggccttctactgattagatgaggcccacccacattatacagaataatactcagagtctactgtttcaaatgttaatcttaactaaaaaaatgcctttgcaacaacatacagattggtgtttaaccaaatgtctgggtatcatggcctagctaacttgacacataaaattaaccataacagtgtgtatgtacatatttaacaacaatccactgactcctgggaaaatatctgtgtatatatatttatatagatatttttccatatctatatatgtgtctgagaaagatatatacaagggttaaaatattttcatttatatattcttggtatgtgtataactatcttaaaatgacccagatttggtgctttggagtgtttgatgtattttattaagactcctctgtatgataagctttatttataaacatagtgctcgtagtgagtattcagcataagcaggataggcctgaagaattctaactattgtgcttttagacctgaccagaaacagtttctgccatcctagtttgtgaaatagacatacttaaaattcctcttagaaaggaacaaaagctcctggttaaaatatgataaaataactacatcttagcttgaaagatgggaactattatatgctgatcagtatgttgggctttttaatttagatttttaaagagcgagaagaagatttgaggcgtttgtctcgcccattggaatgttcttgtttccgaacatctatctgggatgaaaccctctataaggtgtgtatgtctccctgagttccctcattttaagagcatgaaaaaaaacctagaaggatattaacaaacctaaaagattttaaactatttcatagccatctagatttgttgtactaaaaagaaaaataatctgcaacaaattgtttgaagaatatcaaacttaacattaagagacttgggttttgatcttatattgggttgacatagctaccaagtcacactgaattagccagtttggtcatgattaatttgatactggtctttgtaatagcagaggtttcacttactggccatcatccattttgacctgttgtggtctcaatgctgattggagttgtatctagtattcaggtacttctacatgatataagctagtctgcctaagtttggatggcaataaaatgaaaatatttagggaagagattggagaaggagtcttagaatcagacatgttatgcctagcatatggtataat

SEQ ID NO: 137522 - DNA, 1581 bp, Homo sapiens
tgagatacctgtctaggaaatactgttctagattaatatgggccgaatttctctcaaagccttattcccatagaacaggtaaccgtgaataaggatggacatgacgcactgataagaaccaactgcggtgtgaaggatggcaatacataacacgaccaaagacaattggctaatcacaacactgctgtgagtgacaatgtctctgctgtggttagctttggtgccttctccaaggtaaattcagcagtgacattaacaccgacctgggaacttggaacctgaaccctcatgcctaagtaataaaactaattggaacagagacatggcacttctgtctcttacatcaatgttgcatagagctaacttaaatttttatattaagttttattcaacaagcactctttacatacctgcttgatgctgttggatacacaaatgactaagaccaggttcctgccctcttgtaggggagagaagaacaaagtacaccttaccagacaaattggagtgagagtgaaggaagtattataatgaaaatacaaataaaagagcctacaagaatagagggagagtgtggttaatttcaactgcttacattagtcatactcctggatgaagtcagttttaggcaaaaacacagtagaccattttgaattcaattggatcaataatttatatggataacaacaaacctttgggaatgataatgccactagtttctcttttaatggtatattattctattgaggggaggggccatttgtctatgtggctctgctactttcataaaattgattcttaggtatatgttaaatatagcataattaggttctgatctttagagaaatctacactgttggacttaaatatttgtgactagattaggagctttttaacaaagtagatcatatttttcaacttttttcctaaggcaacatgatggcattaaatatttgtttgctttcaattatcaatggaaagaagtttctccagcattttacaaaagtgtttgaacttaaaaaaaattcaactcaagggtaaaaatcagatgctagcttcattttctcatttcatttgtgttatatcatatttaatgtcagtatttgtttgggactggattatcatcatattttgctgtccacatattatagtgtacttactaatttcaaaggtctgggactgactagctgttaataatagtacactgtgtttctgttctgttaggcttggtccagcatagtttatcagctgattcccaatgttcagcagctggaaatgaacctaaggaattttgctgaaattatcgaagctgatgaagtacttctttttgagagagctacttttctggtaagaactttctgctttgcagatgtacttcacactgtacgttctttgttttcagcaacagagaacagcatgtcactactttcaggaagaacctttttccctcttgtcaactttagcatgtacagacttatttataaaatagtattgtcagcaagtgacctgaaagaagccctttggtgtgtagctctttggaagttagtgaaacttagatttttccaggtatgtattattaga

SEQ ID NO: 137523 - DNA, 1100 bp, Homo sapiens
gggtttatgctgttagctccaaaccaaaagattttggaaatttattttggaaattttgtgtttagaatatgaataaatctgcttattcagaaaaattaaaccttgataacttgggacctcctattcctgtatgttctctgacatacattgagggatttggctctcttttgtttatttgttttactagtcagacattcctttggctgcccatacttaattctgttgggtgtttccgcccccgccctcagcttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttagggatttcagtgtctatttttcttttccttgtttcttcaactttgtcctaagaaagagtaaaggaatttcacagttatcctaggtgaaggggaccttctggttgggaaggcacaaaataaaattggatgggaagaatgtagccagattatggccttaaagcgaggcagaagaattcagatataagacatctaaatgcgataggatataggaaagcattgtgggcctttgagcaagggaattatgtgaaagcaattttgaaagaaagttaagttagaccatatgtactgactgatagcagctggggaaactctggtagtaatccatgc

SEQ ID NO: 137524 - DNA, 1073 bp, Homo sapiens
ggtttttgtgttctgtcagatagtcagcttcaaaaaattatgtccaaaatcagaacaaaaaatgacacatggaagttgtcgaggcagggccctaggaatgcataaacatttgactgtgtgaggattggagggttactaaaagcaaggattatatggtttactcatggataacctcagcaaagtgactagaaaaactggaggcactttcgaagtacaggcggaaggcagagaatggactgagtacctgttagaaacagctgttgcaatggacagcagtcaggaaagggctggggccaggaaatgtgttgtgatagactgactctttatgtcttttggagtagatcatggcttactcttttttaaaaaaaagcaccaggatctctctatgttaacattactttgcatttcaaggcttccaactgatcttacagataagtagtcacctgttctgatctgggccttcttttggttctgtgctatccctttgggtttgctcagacagagggaggtgcttatggtcccagctcttggagattgtgcagtcctggacattctgaccaagtgctttgtgctttgtgaacccagaaaatctgagacaggtgtcaattaatttagaaagtttattttgccaaggttgaggatgcacccatgacacagcctcaggtagtcctgaggcatgtgcccaaggtggttgggacacagcttggttttctacattttagagagacatgagacattaatcaatatatgtaagaagtacattaatttggtctggaaaggcgggacatcttgaagcaacggtagaaagactggaagctgggagggtgcttccagatcacaggtgagacacaaatggttgcattcttttgagtttctgattagcctttccaaagaaggcaatcagatatgcatctatctcagtgagcagaggagtgactttggatagaatgggaggcaggtttgccctaagcagtttccagcttgaattttccttagtgatttggggggtgcaagatatatatcctttcacagcttccactgaagattgtcctttaagtcctttcagcatgaat

SEQ ID NO: 137525 - DNA, 1019 bp, Homo sapiens
gaaatagcctctttcaaggaaaacctttcagggtggagcagagtggggttggtaagaaggggaggggaagggaggtggtgctttagagcctaggggagctaccacgggcgggacaggcgcgctcagttcgatggctgtgtggttggatccttgatttctcctccaggtattagagcctcgacttcctccctcctggcattctttctttttatcaccctgcagcaaccctatcaggttgcctgaagcctctagctgtgagctaggagggctccatcttgcctggcttcttaaagggacagtgcactatttaactggaaattcaattatgagaagggtggcagtacctctatgttggaaggaatttgtgtggcgaggacagctttttcttactcagaccagcttccatacttggttctaatatccgtgtggttcttaggaggtgcaccgtgggcaatgttgccaagttacacattagttaactgcagccagttgactgctgttttagctcaaagggaaaatttccatttcctgaaaggcgccatggcagtgcaggtatcttgaacaaattcattctacaaattttattgaatgccaggtgcattgcctgtggctgatcacactgctgggaggtttgtgtaaaatgtcaaggccatgcagagtgttgtcaatgactccctttttaactgattagtagccttcccaggatatggagacaaatgttgaatttgattccaacatttaccaaacatttcttacatgaatggctcaatggttcacttttattgtcttctgttcagtaccaggtgtccatatgctcaaagccaagtgactgggaattccagctagaagaaataggaactcaaatcaaaatggcatgcagagaggaaagagcaggaaacttcagtaggaaagctaatgccactttggcgttatccatgtccagtaagggagattgttttgggaaagagggcttcaccatctcccttccactgttaaagaagagctggtgtggcagaaac

SEQ ID NO: 137526 - DNA, 1077 bp, Homo sapiens
tatttagtaattcaacttctcactatctttccttgaatggaaataagattagagagataacaggagccccagaaagtaagtagataaaggaagttgtttctacctctgggttcccatagcactagactcagcagtctaaggatatcttaatcatgattgtccccagtgcctagaacatagaaggaacccagtgaatacttgttgagggaataagtcaatcaatgagtttggggaaattatctacctatcttgagactttctggcagattatacatcatttttcatgttcctggtcaactatatgtagatcatgcatataggtacccagacagagatatacatgctcattcagaaattgccatccaatcctgatacatgcaaactcataaagatatatctccacacaaatgaatacttggcatatttgttttctgatgctgtaaaatgtaccacaaaatgggtgccttaaaacagcagaaatttattctctcacagttcttgaggctagaaatctgaaataaaaaataaaagtattggcaaggccatgctccatcgaaaacctctagaaagaatccttcctggtctctttcagcttctggtaagtccagatattccttggcttgtggcagtataactctaatttctgtctctctcttcacatggctatgtctgtgtgtatatgagcgtgtccgtgtgtgtgtgtgtgtgtgtgtcttcacttgtcactttcctcttctttataaggacaccagtcataatgaattagggccaccttaatgatttcatcttgattacatttgcaaagactttattttcaaataatgtcacattcacaagtactgatggctaggacttcaacatatcattttaaaggtcacattaccacccaaaatggtcttcctttggccctccaaaatttatgcccttcccatgggcaaaacacattcactctatcacaacatctccaaaagttctaacccattccggcatcaattctaagtcttaaaaatctcacctaaatttaatcaactcaaagagtcccaaaactcatcttctacttcatctgcgtaaggaagg

SEQ ID NO: 137527 - DNA, 1021 bp, Homo sapiens
aatcatttagcctcaatataatgctggcacaacgctagcttctacacagaagtattgtgaggtaaatataaggtaatgtatgtgaagtatataatatagtgcctggcacagagtgagtattcagcacatttgttgagtagatcaatcaaaattgagattcccaatgctgaagccctagaagctgtcatagtagtttgcattaatttgttttccttccattttaattgtgattttaaatgtaataactcctggtgatagacatagtaattcttagttaactagactgtaagattgataagaatctgccattcatttcctataccaaatgaaaacttactggaaacaataacaattcacatttattagacaatataatcatgcactcttagaagtacttcacgttaaataagccatgaatctccactgtaacattataagaactattattatccccatcttatagatgggaaactaaggcataaagcagttatttaacttatccaaggtcaaacaactactgtggttcctgagtctacattttaactactatagtcaaagaggaggagtgacctgcctagtgccacacaatatgttaatattagactaggattcaaattagatttttctattccttctgctgcacatagagacatttggattgtcaaatccattttactatgttactacatttaccttataagtttattttttatagtttttatacaaatatattttaagtgaaataccatgtggatatgttataaagtaaactttttataataaagccacatttttatatgtccagtagttcactggagaggttagtggtggattgagggaggtgctatatatctatatttaacatttgattttaaaataagagaggttgtttctattatagaaaatactacagaggctggtctagaaatctgtttcctgctcccaaccttggtcaaagtctaacctgaagggaatagtagcaggatctatatgtttttatttgttattaatttttccctgt

SEQ ID NO: 137528 - DNA, 1012 bp, Homo sapiens
atgataagcttgattaataaaaacagaatagagaattgaccacaatcaagtattgatgtgtcgtggcatctgaccagtcagataaaagttaggtggaaggcacaacaaagtttttagttattatatcccttattctagaattctacatacaccaaatatgaaaggagttctaaaacagcattttgaacataatggaaatcagcatgtattcagctggagtgctatttaggacagcacttttatttagagaagataagagctctggggaaaaaaaaggaaagattgtgaagggcaatataaggcatgctaaagattttggtgtttagaaacatcctgctacagcagcgtggagcatgcttagaaaagaggagaaactagcagcagaaatactgtctagaggcttttgtgataagtccatgtgaaacagtgggccttaaagtaaggtagtagacattgggctgtagagaagcaggtagattctaaagttataaatgacatgatatggtatcaccaatatttggctattgattggttgtgggagaagaggaagtaaaggtgattcacaggattctgatttgggcaatggagtgaagaatggtgccaaggtaccaaaggaagaacaagttttagtctgtggatgcagtatcagactgaagatattttgttccagagtgtctatgttgaggtgcttccggaacatttagatagacggcctattgtaaatacatatatgcaatatatatggtgagagtagacttaattttgggaataaacaagtcaaaaccatttttaaacactcttactgtattccagaaataaaaggcttgctctacctctccacttttacctataagtatagctgtgctcctgccctactgaactaatcaccattccaataacacagaacacagcatgctcttcacatcacaatacctttgtacatattgttccctttgcctcaaatgcttcctttctctcctcttcagtcagaatatgtatgtttacattctga

SEQ ID NO: 137529 - DNA, 1029 bp, Homo sapiens
aatatcatttagcaagtacttaccttgtgtcaagcaagtttgtaagaactttatatggaatatctcattgaatattcatgacaactctataaagtaaatactgttattaccacttttttcagatgagaaacctgatacacagagcaagtaagtaccatacctaaggtcacagagctaataaagagaagagttaggcttcaagcatctatcttttctgttccatgtgaaagctattccattactgaattctcccactaaagttaccaggttcactttgttaaatatgaattcatctaactgatggtcagcttttgtatagaacagcatttcttccctgatttgactttttattctgtgctttcttagctctttgccttggggcccagactgcttctgctctaaaattaaagttgttactacatggcgtgaaactgctttggcagtctgaggtccagcatctggccaaagagatcctggctgcaagcctgaatgctcatatggagctgtacctggcaggaacaggtgtgatgaggaggatccagcccgggattctgagagaaaggctggatctgttgcaatatagtatttatgagagagaaggtagcctgatgggatccaatgagaagaattgatgaaagagctagtgaaaaataactaccctcatctccattcagttgagagctaattctgaagtcttttcaccctggtggccttttctgccagaaatcagtgttatagccagaggcccagaatttgcaagttcctgaaaagggcctggaaagctggaggaggaatggtcatgagagaagatgggcatcagctggatgtgggattttttcccccagctttattgaggtatacttcagaaataaaatattgtctatatcatggtatacagtatgatgttctgatatatatatatatatatatatatatatatatagtgaaatgattcccacaatcaagataattaacatatctatcaccttacagttaccgtattttctttttttgtgtgtagtgagaaca

SEQ ID NO: 137530 - DNA, 1042 bp, Homo sapiens
ttgttatttttttgtctttttttttctttttgtggagaatggggtctcactatattgtccaggcaggtcttgaactcctgggctcaagctatcctcctgcctctgcctccctaagtgctgggattacaggagtaagccatggcgtctggcttagtttttatcttgagggcaatgagacacctttgagaaatttctgattttggaatggtaaattttagctgcagtgcatgagggcagaaacggttagggagaccaattaggaggtcatttagatagtgcaggtaagaaatgttatggtgggtcttgttactagtattacatacttgtgctccttgagtattctttcctgaagctgatatgacctaggtaaatgaacagtatgataagatgttgctttaaaaacagttcatcttgttttatctaattatatcaaaactacaaatttgtcatagaaaatttgaaaaacaaagaagtataataaaggaaataaaaaccaccataatccttcagctacctacaactacagtactatgtccaacttgatttttttattataaaagcaatacatgatctttatagaaaaatttttaagtaagataaaattttcttataatcctactagctatcctttgttttaatgctaaactgtgtttgtttctgtggcaaagttgaatggcatgtgtgtcggtctaataaaatgtaaatgatagtgtaactatactatgtcctgtttttacacttaatattattatacaaatattttctgtagtgattgagaattcttgaaaaacttaaattttaatggctatataatgtctatctcttactctgttcctgctcttataacaaaataccccagacctggtaatttatacataaaataaatttatttaccacagttctggagattggaaggtccaaaatcaatgtgccagcagatttggtgtctggtgagggctcactgcttccaagatggtgccttgttgctgcatcctccagaggggatgaacactgcctcctcacatgtaggaagggacagatg

SEQ ID NO: 137531 - DNA, 1073 bp, Homo sapiens
cctttttaaggaactccaccctaggtggagtcctcacgatagtcacacctctcctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggc

SEQ ID NO: 137532 - DNA, 1007 bp, Homo sapiens
gcacactggccatgtctcaggtgacaaggaccaggagtttgtgttctataactacgcaatgctggcatcattctagtgtggagaagcctcctggtttgattcattataggatttgtttatttcaaaagttaggactagtgggtgggtgtgtagctcagggcacacatgctgctctcccttctctaaatttctgtatcaacataccatgcagtgaaagagcatttggttgtcacctgccctttatttttcgtttctgattacttcctacaagtgggatgtcttggtcaaaatgtatgagcagtgttagggttaaattttatcatacatgtctctcctttaccctaatttaatattgttaatatttggcacatattttcacacagcctaattctctctctctctctccccccattttattactattgtaagttgcatcaagaaactttacccctaaattattctgcatgcatcacctacaaataatgacattgtcctacataactacatcagcactgtcacgcccaagaaaatgaacaatatttccatgatactatctaactggctcatacctttcttttttttcctctctttttttaaagctgggctgctttctcagggttcatacatttctgtgccacttttccccacactgttttttctacatggattgtgcctcagtgagctagtatagctcaccaaactctttacttttcttagggttcaaattccaattctacctcttccatgaaacatacatagaaaaccccaactgtctcgaatctctagtgaaatcatgctcctggaacactaaattatctgtattagtcactaatgtggtacctgttctctattgtcaactgctttatgtaaatatctcttgtctccccagtaatattttttgtctcccaaacttcaattatttacttaccactttcacgatttttgccacatccttgccatcaatattatttacatactttaaaattatttaaataaataaataaata

SEQ ID NO: 137533 - DNA, 1050 bp, Homo sapiens
aatttttcttttgaaaaatcttcaaatttcccataaagtgtagttatgtactgtttctctctgtaagtttaaaacagctttgtctttcaatattgaaactaattggaagtagttggcttgtgtttagcaacaactgttgtatgaaaaacaaatttctttaagcaggaaaatgaaacttattgaagtgaaatgctcacactgtttgggaacacaaccactgaaggaaacactaccacctcccatgctttctctgagcacctactgagggacctgtacctactgagcagaatggcctagttgacagaattgtttttactattccaattatttctttttggggggacctagcattaaattcacgtaaattaaaagccgatatgatgtggcaccaatgaatgtaaattcatttttttagccttcactttaaagtcactgtttggctttatctctatttctttgatcagaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggtctgcccactcccatctcacccccaacacacacacacacacacacacacacacacacacgagagagagagagagagaggggcagagagagagagagagaggggcagagagagagagagaaaatttctgagagacagagaatgaagtcctgaaacaaagactgatgcatttatactcatgggcacaggctccattcatggtttttatccctatttcttgtccctactctaaggcagattttataaaactggcctaggaaaacactaaactaaatctggtgtcttaatagtcatcattcccagtgagccctgtgggtctttctaattgcggagtcaacacttaagcaaagattaaggcattactcccttccttactaccagggtctcacaagttttactaagcatggaaaagcacaagaacaatttaaactatgtgaaattaaagca

SEQ ID NO: 137534 - DNA, 5610 bp, Homo sapiens
tcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaactgaagtccatactttattcaggtttctttagtttttacctaagatcctttttaaagaattgtttcggccaggcactgtggctcacacctgtaatcccagcactttgggaggccaagacgggcggatcacgaagtcaggagttcgagaccaacctggacaacatggtgaaaccacgtctctattaaaaatacaaaaaattagccaggcgtagtggtgggtgcctgtaatcccagcaatacttgagaggctgaggcaagagaattgcttgaacctgggaggcggaggttgcagtgagctgagatcatgccacttcactccagcctgggtgacagagcgacacacttgatctcaaaaaaaaaaaaattgtttcagcatcttgttcaggattccacattacatctaatagtcatatctccttaggatccttttgattgtgacagtttctcagactttccttgttttcagtgaccttgacacttttgagagagattttcctcaactgggatttgtcagttgtctttctcatgattagactgaggttatgagtttttgaaagtaggaccacggagaagaagtgccattttcatcacatcatacaggcatactttggagacaatgcagatttggttccagatcactgcaatgaagcaaatattacaataaagcaagtcacacaaattttttggtttcccagtgcatataaaattttatgtttacactatcctgtagtctggtaaatgtgcaatagcattatgtctaaaaaacaatgtacataccttattttaaaatactttattgctaacatgttactggcacaaacacgaagtgagcacatgctgttggaaaaatggtgccaatagacttgttggtcacagggttgccacaaacttttaatttgtaaaaaatgcaatatcagcaaagtgcaataaagtgaagcacaataaaacgaggtatgcctgtatttacatgactcatcactgttgtttaaccttgatcacctggctgaaatagttgttgtcaggtttctcccctgtactctttttttcctcccctccatactgtactctctgaaaggaaatcactatgtgcagcccatgcttctggagtggtaagttatatgccacacccttcagagcatgtatcttacataaattatttggaattattctctaagggagattgtctcttctcccccatttatttatttatacaatactttatttatatcagcatggactcatgggtatttattttatacttcgagttataatctaatactactactttattttattgctcgaattgttccagctttggccattgggagctcttttgggtgattctcaagttcttttgacacacccccatcatttttttttagcacgtccttactttctgccactgcaagatcttccaggctcatcttgtatattttgtggcctactcctataatcagccatttcttcaagaagtcctggtttcttttactggaaaattgtattagaaaccaatatctgggcattaggtatgttcattgttactgggctattgttgcttctagggtgtctcagctaacagcaaggaaacatatgtgtgtatactatcctatgtatatgcacattctataaatatttctatatgtaatcacccagatttttatttagctaaacatgagttcatattgatgttttcaactctaacctgttaccacgtgaatcattctagcttcttcctgttagttacatgaagcctcccacactaatactgagaaacctggctctcaacctctgtcatctatttacttaatttttcaaattcagtgtgcacatatagcagtatctgaattgttaacctgtatacccatgggaaacaactttatcaactacagcacagtgtgtatgtacataaaaatagtaatatttttagaactccaacagctctttgaaacaaagtggtctgcaaaattctggaattagggatttctgtgatctgagttccaagattctggggtctatcctgcccccaaaaagttttctcatgaaccaaaccatcaagaatgtacctaaccttaaataagccaagggaacttactgatgctccacagtttgctaattcttgtatgaggtactgtagagggatggatacagaaggaactgggtgggccaaatttaaataaacacatagcactatcttttctcactgttaaatatggctctctgacaacagtgatgctaccctgagttacctctcttctgtattttcccagatctcacttggttgaccttaggcaagtcatatcacctctctgtgcctcaattaatccatttgcaaaatggggatctcaatatctacctcacaggaatgttgtgaggcttctcataaattgattttggcaaaaatgaaagatctttaagtgaacaaccaag

SEQ ID NO: 137535 - DNA, 1294 bp, Homo sapiens
ccctctctgcctcgcctgctctgtactgttctgttctcttctctctctccctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgc

SEQ ID NO: 137536 - DNA, 1506 bp, Homo sapiens
tgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggataaatcttttctttttgccttttggccctaggatcgtgtttaggaggattatcccaccccgagattatataaatcttatcctatatttctctaacttatatggttttatttagaaaatgttttgtcctgtctggaattatcttgatgtatggatttaggtattctaacttttttgccccaaagggttagccagttgttaacatatttaccttttcccccaacatatgaaatgtcatacatgtatatactttattctgtgtttggattc

SEQ ID NO: 137537 - DNA, 1087 bp, Homo sapiens
ctgcagctggcttgtaaagctcttcaataatttatttggttaccgcccacccccgcgtccctcccacacatataagccattcagagtttaccacttaaaggtaaacttgaatttcttctcatcttaaaattgcataaattatattaaattctcaataaatttatttacatttagtgggggtggggcgcgatggaaaaacactatattaaataacgacatcggtttttaacacccatcctaatagaaacattaaaatagaatggggtagggaggaggggtggaggcggagaagggatgtacgtctcaggatacaggaaatacggtaagagcgaaacaggaggaagccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccaggtcagattctttctcatctaggacatctaggctctttgaaacttatttatgcattctcacaaatttccttccccttttccctgttctttccatgatttcaaaatagaaaaaataacatgcagggattaagcagctctttcacaaaatatgcttgaatgaaatgatggatatttaacgacattaaataattatttgtaatattttagatgaaataattgtagttatattttctaagaaatagacttgaatcttttgatttgcttgaaagtaagtcattggtgccaaggtggagggaaagtgtaataaaaatgctcatgagttgataatttaaagctgggtgatgtatatgtagggatttattatattattctctctacttttgcgtgcattggaaaatttttttgttaaaa

SEQ ID NO: 137538 - DNA, 1055 bp, Homo sapiens
tttattctaataatgtatagattttcttggattatctgttaattaattatattttgaataatgacagtttctttacaatatttctttaccttatattactgtgctagctaggatcttcagtacaaagaggaacaacagcattggtagaggatttccttattttgttcctaaattctacaaaagtttcaccttttttagtagattgtctttctcaagttaaggaactttcttaatgttcctagtttgctgagaggttttattacaaatattatgaagttttttcccgtctatatgtactgccactttcatatcctttcttcaccattaatatcacagtgtgaccatgtgataaattacaataatcaattttctaatgtatttcttgcttttgctttcatcgagcctcgtcattggatatttggttcctattttaatcattttgacttttatttttatattgaactttcttctactttccttttattgttctttttctaatttattgagttgaatctttagcatcttaattttcaatgttcttctgtaaaataagaatttagaactataaattttcttctaccactttagaaatatttcacagacttttatatatagtatttttatcattcaatatttattatttttaaatttctcttatgatttttttgacccatggtttgttttttttcaatttctaatcatatgggattccttttttaaaaaatatattatgaaatcattacattattcccattctagtttaactttatcttatttttcttttttaattttttttacatctatagactttattagatgttctttatacagtcatctggtatgtataaagagtgaacaatcatataaaaggaaatatggtcataactgattgaattaataaaatcctgaaactaaataactcataattcattgcacaacatatattaggtttcattagatcagtatatagcttagtagtaaactctcctgatggccataaacctctaaggtgttgtcatcctgaaaaatgaaggaggggagggagctggtggggt

SEQ ID NO: 137539 - DNA, 1053 bp, Homo sapiens
gtttccattatcatttgtttcaagaaatttttcaattttcttcttggtttcttcattgacccactgcttattcaggaacatactgtttaatttccaggtatttgtatagtttccaaaattcttcttgttattgatttctatttttattccattgtggtcaaagatgcttcatattatttcaatttttttgaatgttttaagacttgtattgtgacctaacatatggtcatgtgacctaacatggtggctttagagaatgatccatgtgctgaggaaaagaatgtatattctgcagccgttggatgaaatgttctgtaaatatctgttaggtccatttggtctacagtacagattaagtgtgatgtttctttgttgattttctgttcggaagacctgtccaatgtttccttgctgttaacatagctactccacctttccttttttggtggtatttctttttccattgttttactcattcacttttttctttcttttatcttttacaaaatgttctgccaaaaaatcaatgcattgatttgtttgtttctgaatttaccaatagaatttataattagtattaaggataagctttatatatccaaacattatctttctttactaattttttattttatagaatttaaactctacagaaaagtcaaaagatatctttcatgtattgtagtgccattcttttccaagggagatacattccaaaatccccagtggatgcctggtaacatgaagagtaattaatcctatataaactatgtttttttcctatacatacatatgtatgataaagttaaatttataagttaggcacaatacaagattaacaacaacagtaataaaatagaacaattattacaatattcatagtttcatggatagaagactcattcttaccataggtcttagcaacttcaacacatgatttttttcttcccttattaagttgaaaacttcctccttttcacttaaaggaagcattttacagcttctctttagcatatgtgaactgccagcattatcattcttgcactttggggt

SEQ ID NO: 137540 - DNA, 1036 bp, Homo sapiens
gggatgattcacatctggagcaaacatgagatttcatcacactactcacagtggtgtgaaatttaaaacttatgagtcgtttatggaattttccatttactgttttcagactgcagttaatcatgggtaactgaaactgtggatgaggggggaccactttagattcatcagggcatcaatttggctacatatggcttatctctttttctaaatactatatacatatatgtatatatacatacacagatttttttgctgagccattgggaagtaacttgcagatatcatgacacttcaaccctaaacactaaatcatatatctcttaagaacaattaaattactattacacccagagaaatttaacattgatacaatactattatctaatatactatccatatcaagttctcacaattttcctaacaatatcctttatagctttttatttgttttggtccaggatccagtcaggggtcatgcattgtatttagttgtcatgctcctttttagtctttttaaatctagaatagcaccctccctttttttttcttgtcctttttttgtgacgttgccatttttgatgagtccaggtagttttcctctatatgtctcacagtatgaaatgtgtctgattgttttcccatgattagtttaagcgtttttagcaagaagactacatgggcgatgttctgtccttcttaggcacaaaattctagtttatcccaagagcatagatacctttggggattttacagatagctaggtgggtattttttacttcccccttaagaaagttacttttctggacacgggtcaaattatggtttataatttgcaccatattccatgtctaggttacctgtttacagaaatgctcagcatgaagaggagtttctatatctgttctgccatcacattttcctacttcagagcatttacttagtccggttggttgtctgtctgtgtattcacaaactttcacaatcaactcaatagggaataaagttttttttttcagcagcttcatgtgcagtc

SEQ ID NO: 137541 - DNA, 1007 bp, Homo sapiens
acttgtggtttggggagggtcgggtgggcacaggcacatcattagggagaacatgcttacttttcctaagaaaattagatggatcctggctgacccctgaagtgcataatcagaatccccctcctctttctgccctccctattgccataggtggctgattacctctttttcttggtgtccggtttctccccatttttcatctctcctcccatttccagagtccttccctcccttggccttatgtactagggacttgatggccccttgaagtgtgctgatgatattcagagggcaagattttgcctgtacctttgttctcttttgctcctgcaaggctacttgtggatcagagcccttgatcccactcagaaaggaccccatcaatgagaagcttttcagtggtgtgtcctttcacccggacgtcactcatatctctttgtcacttgttgtgtatgtcaccacgcagtgatacacccctgaactagatctttcaggacagctttggtgacacgaagctgccacttgttgttgttctttttctcctctttctttcttcttcttcttcctttttcctttcactttcagctctctgcgggacaaatgttctatcgagactgcttcttctgctcattggtgatgggtgtgtccccttgcagcaccaggcctggaaggaggcttcactttcatttttaaagaagcagagatgaaagtcaccagttcagtttctctggtgaacaatgagaacacttggacacagggtggggaacatcacacaccggggcctgtcttgctgtgaggggagggggagggatagcattagagatatacctaatgtgaatgatgagttaatgggtgcagaacaccaacatggcacatgtatacatatgtaacaaacctgcacattgtgcacatgtaccctagaacttaaagtatatatataaaacaccacccaggagttacttttaagtgaaatgtcatcgtgaattcatggatttcccagtacctct

SEQ ID NO: 137542 - DNA, 1272 bp, Homo sapiens
tctgagaaatcaggaaaatttgaaagccatcaataaattatttactctttgataatgaaaatattttaataaaaatgctaaaaacacttaattttaaaccaaaatacagtatagtatctggtaaagagatttaaacctatgttgcaaagatgattaaaatgattcatacgcaatgaccctttatagagattcatttaaattaaaatttatttttctacatcaaaatgaggagatcatcatgactaagaaattttggattactaaattcttaaaaaattgtccacttttaaaattctattaaggtacaataaatcaaacatatactatgttttctttatcatttatagaaatttaaagtatgataacaggtatttcttgttgaggtgattagcttgtctctcatacattggtgtttggagaattgtttactgaaacatttgaaatggtaatccacaaattgtttaacttttttattataccatctgagaatatgtttgcatatttgtgaaaacaattggaaactgtctcagttatgttcattttgagaattactatgttttggtggacacatttgctggaattttgtgcagatatttttaaaatatttaagtttatgtggttactatgagatattattaaataaataaaacatgttcggagtaatgtgtataatacaaactcattttttgtaacaacaaacagaaagagttacatgttggtaagtatatgtgtctttgattggttatggaaaaaattattaggcatttattccatacttttaacatcttttaacctccacagatttagaattgtttttctggaagaaattgttaatcttctcttttatacatttcatgttgttttcctcattttaatgccttcgtattatatttctaaatataattttcttttataaaacatgcaaattttatacgaagaaaaacagcataagtaaacttaaagactatttatatacaatgtggttccatttaaaagatagataatggatgccattaattcatagaatatataatacatttctttatgttaatacagaaacaaagcctgatagaaatatagtcaaagaacaggcaattcataggagacaaaaatatatggccaataataataataaatatagttgactttaatattaggtcatcatatttgccacaatcaaaaaagtctccagaattctcagttttagaaaggatttggttaaatatctactgtctataaaattgtacgtttctaaagtattttatctctatc

SEQ ID NO: 137543 - DNA, 1150 bp, Homo sapiens
aaaggtctagacagaattgataactatgttttcttctgtaaataggagaaagactgaggaatggtaaaagtttagcagtaagaagaattatgtctatgttgtttgaattatatacagttagattgtattcatgtatttattcatgtattatttgtgtaaataaataaataaatataaaatttccaaggaatataggagtttgtcaaggggctatgagggaacaatgaggctgattgattagttttggaagcctaataaaacaagagtaatagcggtagacatccctgtactttttgggggagaaatatgcctaagataatagaaacatctggtccacctaacagataaattattttgcattcaaatacattagataccaaaaagatgcaggttattgacattgtatgcctttgatttaatatttattaagcactcatctaataattttgcattctctttaacttgcttaatagggaaattggggtgttttctgctcaacagacatatctgacctgtatgataatggaatttctcattataagtcaataaacttttgttctttctgtatctttcagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatg

SEQ ID NO: 137544 - DNA, 1083 bp, Homo sapiens
tggggaaacgcttcgtatttcaccgaaccgcagatcttagccagactgagctggggaggaaggttactgcaggcactcagccagggtgccttgatttccagctttgctatctagctttcgggaaaaacaggtgtgggtttactgggtgcgctgattaggagaaaaagctctccgtgttatgcattgattttgttaatttcctttctcggtccacctggcaactgtgctcctcttcgcaggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcaggtacctgtaaatccctctctgtatcttatcaaatatgatggatttgactgtgtttatggattggaacttcacagagatgaaagagtgtcatcacttgaagtccttcctaatagagttgcatcatctagaatcagtgatacacacttggcagaaataatggttggcaaagcagtggaacatatttttgagacagaggaaggttccaaaaatgaatggagggggatggtcttagctcaggcacctgtcatgaacacatggttttacattacctatgagaaagatcctgtattatatatgtaccagctcttagatgattataaagatggtgacctccgcatccttcaagattccaatgattctcctctggcagagagggagccaggagaagtcatagacagcctggtaggcaaacaggtggaatacgccaaagacgatggctccaagagaactggcatggtcattcatcaggtagaagcaaaaccctctgtgtacttcatcaaatttgatgatgatttccatatctatgtctacgatttggtaaaaacatcttagaggtcatcttgaaatttgccaaatatatgagactctaaatctgtagacacagaaagtcttgattg

SEQ ID NO: 137545 - DNA, 1023 bp, Homo sapiens
gacgtttttcagtgatgtggcatgcgtttttttttaactgcccccccagccctgacatgttctttttttggcaaacatacataatgttacatcatactatgatgaacatccatgtacttttcactcaatttcagcaattatgaatccatgaacaatcttttttaacttagcctcactcactccccatgttctagtattattttgtaacaaatagcagacatctgatcattttatccataaatattctttatatatctctgaaagctatgggatgatatggaaaaaaatgataattccattatcgcaagtgatatttacagtaattctttaatatcagtaaatatccagtgagggttcaaacttccaattgcctcataaatgctacttgttttattatttttaattagtagaatcccgtaaatctcctaagtgtcttcttaatccgtatgtttccctttcatctttctttttttccttgcgattttgtttatgaaatgaggttgtttcacatgtagcatttgccacaatttaagttttgctaattgcatccctatggtaatgtttgctttcctctatcctctgtttctttaatttgctagttatgtctagagacttgatgagattgaaacatggcttttggcatgaatgtttcataggttatgttgtgttcatttagtaggtggcgcataatctgtggttttctctctttttgtggtattagcagctgctgcagataaatgcattaattcatgatgcttctgatatgatgagtcatctttgtagagttactaagcattagcaaaggaggaaatgctatgtaatagaaatattattcaatgccaaaatattttcttaaatagtcatagaactaacaagaaaaaatagatagcaaaaaaatgtgttggctgttctcactgtttatcttcctaacttcttttgatgatggaaggcagttttgtggaaattgccagccaggactttgacatgaaacagacccagggctaaattttggctctgtggtgt

SEQ ID NO: 137546 - DNA, 1368 bp, Homo sapiens
gcctttctgtcctcttttataatggatatatctttttcctgccattatccctcagacattctcctcatggcacattttcttcaaatgctaacatttactgagtgtacattgaagttctgtgcatacaggaagaagttattttctgagcttagataatactatgtgtatatgtgattaaaatgaagattattttctaaagccttcaaattagaagtggatttctgtttcattacttccgttttaaaagtttttgccagagagttttgctaaatactctcttatttgctctagtgtactagtccagtagtgtttgcatgtggatgtctgtggatgacagttattgtagcactttggcagtgcactaaaattttgccactatgaaatgtttctttattgtgtgtgcgtgtgtgttttgaaatacgcacacagccacacccacatatatattaaaagtggttgtattcatttagtgaaaaacaaaaagtagatgtacttctgtaaatcagataaatgcttggaatttgattgtctacccaatcaacagttttccctctttgctctggaaatatttgtactcatatagcatatttcaaaaatgttgtcattcattaaggcctcttaaatagaccactattttttgtgtctggcagatgagtatgtcaaggattgagatgaacacataagtcttggaaattaaataaatttataaacataaagataatttaatgctgtgacttcattttttaaattctttaaaccaactttctcccaataaaaaattataaactatgtcttttcctacttactcctggaattttcaaaggaaaattttacgttctcaaagggaacagcttttatttgtccatgggctcacaaagtttcactgaacaaatttgttcaaatgatttctctttcaacatcattttctagcaaaatcatggagaacagctttacactttcaaggtaataggtataattctgttggtggtgacaagctgcacttaactagtctgaaaaaagttgccatcactccttttaaataatggtacttgttttaatttcatcctgtttcctttctgcttctcctcaggcattgacttattaaaacttctcgtcaattgcaaacacagtaacataatggcttaaaaagaattatgtttctaggggctccattgatcatgttggtcataagctaaaaatacactgacatttgtattttttaccaattagtataattaatacaacaaaatgcttgagtagtagtcgagaaacatggatagactatgaagtttgtctctgtgacctacattgttcatgttcatgtccaggaaacatataagaaagcaatttgtaagctggagattatac

SEQ ID NO: 137547 - DNA, 1095 bp, Homo sapiens
ttttacacagtacgaaaatctaatgatagagctcaaaaaaaaagagctaaaaataggagttggttcttcttagctgtttatccttctaaccttttttttaaatgatgaaggtatgtttttgttgtggaaaatacaagggcttttgttatcactcagacccagagtgaaatgtttgctttgtggttttgaataagttggcctttaataagttatttagtctctcttagcctcagttttctatctgtaaaatggtcatagcaatgtgaacatatgtgttacatcctagacttatttttctaccccagtaggttgtattgaaaggaaaatgttatatgtgtttcagcatgttttggtgaatcttcattccctttcctgccccttgttttccctcctcaaaggggagaaattagcacaaattagtatcaggattgtgcaggaaataaacatttgtgaaggttaagaaagaggaaaaggaagttatttcttcaacagattaaggatttttctacacacagttcttttgtggcattggccacatgtccattagaccaatttgatagtatcttcggtctgcattcaaagccagctcatgcaatgagtattcagcctattcttccaagacaatctggacatagaccagagggagatttttctcccctctgtgccctagagagctcattgctggcttactcttagagttgaaatgagagggttttgtctgcattttgagtagataccatctatcttatgtgagtatagcattttacaatttagcactttcacaactattatatttgatcctcacaatcctgtgaggtaattatggcaaagtcagatctacaattcatattaaaatttacctagctcagattacaaatgtatttcacttagtaatgtgtgtgtgtgtgtgtgtgtgtgtgtgtgtgtagctcaaaacaaagaggaaatatttcccactctcccattcgactcttgagtttcatgactattttgtttataactgtttgctgcctcccaccttaattgatttctcttacattctttgtactccatgctatttccttgtaggtgtacaccagtccttgccatgaatct

SEQ ID NO: 137548 - DNA, 1080 bp, Homo sapiens
caccacacccgggtaatctttttttttttttcgtatttttagtagagacggggtttcaccatattggccaggctggtctggaactcctgacctcgtgatctgcccacttcggcctcccaaagtgctgggatttcaggcatgagccactgtgcccagctgatatctatttttttaaaaaatacttggtttacctgttttgttcactcatatgcgagtgcctcataattcagaatctaatttggtgtgtggctagactaacaacgttcttcttggactgccaataacacctgcaaaacctatcccacactcatgggaacacatcaatgctatttattattggcaatcaacaggaaactcaagcacaatgcacaacagtcacagcaaggaggaacatgcaattgccaactacaccaaacgtgcctatagccttagccacagcaacatataaaatggtaaatctaacctaatgcagggcttgcttctgccaacctgattttagaaaatatagtgtaatacttcttccctggcaacgctgcatcatatacctcacttatttagatgagccgattctcctaaccgttgacattcaataaccttatccagagacttatctcacgtaaatgtatagacaatggtgggctgagcccatgacaaatttagttaacccaggtgctgaatgcaaggtggataacacaagcttgtttgactataccattttctgctcctattaacacaacctggaacttctggaacttcacaaagccatgtgaacttcccttcagtggaacagagaattcaggcagcagagggagcctggaggtcctgtaaaggaatcagatggcttccctatcacaatcttctcctcatccaaccctgaagaatatttcctgcacttgggattggtgcaaaattccagtagaattttattcaacagtggaaccccctccctcaagtactttccgccaccaaaccacactagatgtgactccccaatgtcacaaatgagctttccaaatagttcctcatggtactaacttccctaggatcactaattttggaggcagtaggaacagcatatgt

SEQ ID NO: 137549 - DNA, 1015 bp, Homo sapiens
agccttaataggtctttttgggagtaattatttttatttttaaatatctagtgtaccaccatggcatgtattctttaaattttatacaaacaagcacattttttcagtgttttgatgtattttcatatttttctaacttagacgtgtaggcaatacattttatctaatgaaccaaaaattttggttggggtgacctcagagcataacacaacctctgaaatgatttcagctaggaccacactagtcaaggtaatctattacacattgacccaagtagtttgagcaatggaacacgttaccttagggatagcagtacaatcctattctagaatccgtatcagcaatagggtgtatgacttcgatattggatcaggatattccaatgatgtaactacaattaatggctcatatgtccaatgattaaagtcctatgtgatctgagttcagaccagagtaatccaggtaagctgctatctattcaatatttctctcagtacaaaaggacaagagaaacagggcccacttcaaaaagtgccctcgagttaatagatgatattatttaaatcgaatacactatttctacaccctgtccaagaatagagtttgttaagatggcagagctgtaattgtataaaactttataatcagaggttaaatccctcttcttaacagcatgtttataattaaccttctcctatttattgtccctgccattctcatcatagcagtgttaacattaaatgaaagaaaaattttaggtcacatataactttgtaaaggtcctaatattgtaggcccatacagactacccacaaccttttgctgacacaataaaactatccattaaagagcaactatgaccactaacatcatctattcccctttatattatcactccatccctcaccttcaccttcatgctcatatatgaatccttctccctatacccaccccttaattaatatgattatagaagtattattcatcttagccacatcaagcctagctgtctact

SEQ ID NO: 137550 - DNA, 1065 bp, Homo sapiens
tcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggct

SEQ ID NO: 137551 - DNA, 1971 bp, Homo sapiens
gtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgac

SEQ ID NO: 137552 - DNA, 1037 bp, Homo sapiens
cctcgtcttttcttctttttctccctcttcacgtgatctcctccccttgcatcctattgggtcccttccctccctctttcccagtccttttcctccccatctccttatataccccctctatccgcccccaagaagctccccacccccaaaccagaactggtggctggtgactctcgccggtctggggagagcgagcttgcttgggagccttgaggctctgattggcggtcgcggctagcacgccagcgcaagtcccgcccctgggcagcgaacgtgctactgcggcatctgttattggtcggcgggtatgtcagtggctctggccgcgcctcacgcaagcgcccgcagtcgctcggtgaataaaaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtcc

SEQ ID NO: 137553 - DNA, 1041 bp, Homo sapiens
gtgtttagttgtagagcctaatctcctggataattccactcctgagcctcataactcattcagtcagctaagcccctctgacctccatgtccaggtgtatttgtttacaagctttatttgaactgcaagccattggacattcgggacacaatcactcatcatcaaattaagcatggagctttgcttataagaggtactcaacaagaatcacatagataagcaggtaggtgggcaggtaggtagccaggatatggtaatatgttgaaattgcaaaacaagaaaggaggtaagtatagctggggagtttgtaagaggctagattatatgtcggagggagactaaggaattcactttgaggagctgtattttctgtagaaggccaagatagtctagcaatgagactctaagtgaagatgttaagaaagggctggacatccccaaatattggtaaagaagagaagagtgcaggacacataaatagatgggggcttatagaaattcatgagggcctagctaagactgctgaagctctctgtggactgatagggagagattttgaagatatgcaatgtggaaaaagcaagatgcagaatactgttgacccttgaacaacacaggtttgaactgcacaggtccacttataccgggacttttttcaataaaagttaataccaagtatacctgcctctcctgcctcccattctacctccttaacttcgtctgcctctgctatccctgagacatcaagaccaacccctcctcttccttctcctcttaagcccactcaatgtgaaaacactgagaatgaagatctttgtggtgatctacttccacataatgaatagtaaatatattttcactttcttaggattttattaataacattttattttctctagctactttattgtaataatacagtatataaaacatatacaaaatatgtgtcaatcaactgtgtttgttatagataaggcttccagtcaacagtaggctattagtagttaagtttttagggagtgaaaagttacacgttgattt

SEQ ID NO: 137554 - DNA, 1793 bp, Homo sapiens
ctgccacttattgcagggcatcttatccagtgagcaccagtggtataccatagcaacaaccagtcaccttgggggcatgtgctgatttccaggcctgtcctagcctaggtaggaatcacttgccactttctgctaccacacaaatgcctacctgtgccaccaaccaagagaaggtgattgtgctcatggctttggtttctctaatccagattcttacccttgctccctggcaagcaagggcatctggcacctgctgtagatgcattcctgagttccccccaactgcaatctctaagcaagccaaaaggcctgaaatagcagttgcttgaaagtgctgtgggcagtgctgctgcggatataattgaagggatccctagggccccttcccaggccagcaaagaagcttggtggccctcagtatttcatgaatcaagcaaagccaattaaaagcaaattagcaagacaaaaaaagagaaacttacgggaggggagttgatatttcatagaaattggattaactgtcctgggctgtccagggagggaaggagcaggcatgattgctaaaggaacttttggagcaagaccctctgggaaagtccataaaatctcattatatctattagaaattcataagggtcctggagtctgagaggcctgtgtttctgccaatttttgcccccagttaatcaactgggctgtgggcaaatctcatctttggcaaatcttgggctagattttacttgactggttcccatatgcaagtcagagtctgggctacctcaaatgactcaggactttttcaactacctaagtgcaggatttctcaccctgattctgactcaggtggcccgtgagggagtattttttgttttacccatatgatgctggtgtattgaacctgctggacaagagcttttcctgttctgccatgacagatggctgcctttgctgtggtcccctgaggagtgctttgcagtgcttattggggtgggggtcgggggggtgggtggcgttgatggagggaatttcttaagaacttccttttatcatcaagaaactcactttggtcagctccagcactgttctatggtctgtttgagggctggggttgtgcctagcaagtggtcagcccttgtttccagttaatgtttaaagcagacgtaaatccaacagataagagagctttttgtaagcctttttgaaactgctgtggacaagctgctagttccccactgccccacttccaaggaagttgactgggctctgggccctactgatcgtgttcttcctttgcttaataactcctaggctttagctgagctgcctggcttctgggaaccaaaactagccagtaagagcaagtgacctgagcgtgacattttgtagtttgcaaactctttccatctttgttatcttctaaatggccctaaaaagtagatgaaaagagcaggtaatttcatccccactttatagatgaataaaagagtcatggagaagtagagtgacttgctcgtggttatatagaatactgactgcaagtcagtgtggaaaagggtagggcaggctggggtagaagaggtagaagagaaagtttactgctaataattctccaagcacaggatgaataacatcattgatatgtgccaggcactaaacactacattttcttgtgtaatcctcaatttaaccctatgaagttgacatttggtgttatccctattttcagataagaaaactgagactcagggaggttaagaccctttccaaaattcacccaactagctcactggact

SEQ ID NO: 137555 - DNA, 1048 bp, Homo sapiens
ttgttgggctttggaaggtcacacaccacagagtagggcctggggctgagtgagagttcatggtttggacagccttgctgcctgcaagtcccttcactgccctagccagcccaggaataggatccttaccacctgaagtggggcagccaggatatgtggctgcagaagcaggttcctttgaatttctagagctaagcagtttgtggctgaaacccaatggcagcctaggggaggaaggaagacctgtctggggacccatggtgttgacagcacagggtgacattgggagagccagccaagcttcaggcctgtttccaaacacagactagtgctggcttgggtggcagcaaatacaccccagaccactaaaactgttgatatcatgtccacacctccaagagtactactagatgaacaacatgtctccattgcaaggtcctggaataatgcttttggatgtgattttaagggaaaatgggacttagtggaagtagctgccttcatcttattacccaataggcctagtgccagacagctgtgatcctgagaattcccagatgagactggtccttggaggaccagtgaatgtggatagagaaggccacctagtaggcctctcccagggccaggatgccagtttcttggtgctttagagtctccaaggaagcactgccttggggcccagttcaagccagccctacctatctggcctcagcttgggtaccaggccacaagactgcccggataatgggttcagtaaacaccagtctctctccctccttagtcctatgccaagaagggaagtagcttcacacactcaggaggctgggtgtgtacccttcatcctgctgccagcagctttccttacctgtgccagtgccaccaccccacctgccctcagcccccaggcccagttgctagagggaggcatggggtttagcagggagacttcaagtttacccatgtgtatgttgcattcaagttgtttttaatatatatatatatatatatcaaaagtcaattatctatttttatattgtttgcattt

SEQ ID NO: 137556 - DNA, 2593 bp, Homo sapiens
ctataacctccagccacaggcctcccagagcatgagggccaggcctcgagatgtgctgctgcctgttgatgagcccagttgctcttccagttctggaggcttcagccccagccctctaccacaggccaagcctgtgggcatcacccatggcattcctcagctgcccagggtccggcctgagcacccccagcctcagcccactcactatgggccttccagccttgacctgtcaaaggagagggctgagcaaggtgcctctcttgccaccagctactcctccactgccatgaatggaaacctagccaagtagttattatcaattctggagtagggacacggggcctgagcatgtgaatggggatcaggggttgggcagaagggtgggggggtgggggttgttgtttaacttgaaaaccctttgggccaaggaaaactcctgtgagttttcaccttggttttcccacttgcctcttctgccatctatggccacgttcaactcaagtgcatctgcccagggaggctgctgctgctactgcactccagtttttgctttcgaggtttcttcttgtgacccacgctgggtttgggatgctgtaattttgtgcctattccagttgccaagttagtgattatatatatatatatatatatatatatatatatatatatatatacacacacacacacacacacacacacacacatacatacacacacacacacaaacacacatgcacacacatatatagcatgcatccttgacacaggctaaacctttagtgccccctgcccctttcccccaatgaatgatgaaccactgattagcagccaagtctgcattgcctcccgcttggggaagtggggcttatttgctattagcaatgtgaaattatggtacagatcctccccacccctattccttttggcctggcatagctgccatcattatatcagatgactataagctattcatcccagctagctgtccttagagaggatcaagtagcgtgtgtctcacagcctatcgctgtggactttggcatcatgaccagatgggggccttttaactgtcctgccatagcttgggttaaagacaaaaatgctaatccccttgatggagtgataaaattcatccatttgcaaacagaagacaaaacaaggttctgttgtggacactgccatagagtgttgagctccggaatgataggattttttttccttcttttaagcttgtgactacctgagttgcagatgcttttgaatttttgttcttttttcctctaaaggaaattttcataatctcatcacaaggaacacggtcttttaattgagataagggaagagaagcaacctaaattaggcttgactataggggctggggtttttgtggagtgtaggggaaagatagaaaatgagggtccatttatcacagccagcaagaaaggggatttcagaccatgcagagcttaaggtatctcagtttcttaaaagggaaaactcccttctcaagcctcccaacacaaaatgttccttaagccttgcccatcccatcatttggactctgtaataaggccccaggtttgcactcccaagacaggataccaaaggcatctcagctgctgttctgggccctttaaagagcttttatcttccaattagccgagtccttagcatcatcaaatgacagggcttcttggcagttgcagccctttatggaatgaatggcaccctcccttctcctgcatccatgcagttttcatgttaaactaggttggaaatactggtggggaagagcttgctgtcaggaagacattggaacaggctaatcttgccaagctcaacctctcattaatcacctgtaggagagggttccttttacatgtctttattggaaatggcatatggaacattttttgcttggctgtgttcactcaaattatgattattgcaccctcgccctcacatcccaccatctccatgcctgttgagagaagaagtcaacagggttcttgccattcctgagatatggcaatttagcttgggaacagatgctgtttgccccctaagtcaaggtgactttgtgggcaaactgtttcttggccaggggatgtgtccatgctggtctttgtcaccatttctcagattggggttggcccagtgcccttactcacaaatagcagacctggctggtagaagctgcacccctggaagcaccacatgaatttgcatggcactaacaccaccactcaagggacccagaccagctcttcaggctgactttggctacagatacattgtgaagaaatgtatctgttgtggagctggagaatgaaagagggtgaggaaggccctccttaccccaagcacagcattccaagagagaagtgcccaaattccaactttctggcctcttaccaaagctgctctgggatggtggggctgaaattggcctggctatttggcaggaagtaaacactcaccaaatgcctttacaacagggaagaacccacctcttgcctcttctttcagggcagcttgagctcctgtctacatgtggactgtgccagccacagcaggcggtagagccatcacc

SEQ ID NO: 137557 - DNA, 1051 bp, Homo sapiens
caaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgaga

SEQ ID NO: 137558 - DNA, 1036 bp, Homo sapiens
agtggtcccctgagcttaggatggtctgaagggagtggacccagcaagaaggtaggggatgaaggcttcttgttgctcagtgtagagttttgcttccttggggcccagagagagctggcccagcaagccaagcatatcgagtggattaagatttgccccacattttccatcattttctttcttgttccactcaagcctgacgtccggtgaaagcaaacccagcctggatgcttgctcactagtatctgtctctctgtctttgtctctcctatctcctccagaccccactgtgatgcttcctgactgataatgttataacagtgcctggaagcctgaggctgcatttccagctggacgtacctcagttgtccccatcatcatggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggag

SEQ ID NO: 137559 - DNA, 1034 bp, Homo sapiens
tggattcaagttcatcagagtaccaattttcctaaccatgtttccataaaggccatcggaagatgtcacactattcaaatgcccaatgataagacttctgatgagaccaaacaggtcacattaaatcaatagaatatcttagaaataaaaccaatatgactaaatccaaaacatatcacatgaagtaccacatgtgcaatacaaacctactttaataaataaaagaaacacaggtagctgcactcagggagaacattcagttcctgatggcctcttagtcttctctgagactccactgccacttctacctgggcaagtctaatggtgcagccatgaagtttttaaccatcttgtctcattaatgccgtggtgccagactgcaccacaacaccagctggcacatgacagaggattcatgctcatgggaatcatatttgtcaccaatgggtgtcagcttctcaaggccatgcttggcaaacacacttttcagctttgcttctaaaagtgacaaccgttggaagaccttctccagagtgagcttctggtccccaggctctgattcttcagaaatgcactctgtagtcttctccaaaatgtcagccacctccaccaagtccttacagaaactctggattccaaatatcttggcgtcttccacacatctccgggttcacctccttatgttttcacaatcagctatagctctccggtatctcaccattaaatcctggacttccttctccagtttaacaacttttacccttaaggcttgttcagcaagagagggcccaaggtcatcaggaaggtcctcggaatggcagtcctcaccagcggttccctgggtggcagtgctgaatggaagtgggcatcccttgctctcccatgaggcactctaagccagtaggtgctacacccgctggcagcccgcccacgttgaccacatggccatgttcccgacttgggctgatggaagcagcacaggcgcacttgctcaatatttctttttttagttataattttttttttgagatggg

SEQ ID NO: 137560 - DNA, 1031 bp, Homo sapiens
agaccagcctggccaacatgaggaaaccccaattctactaataatacaaaaaattagccaggcgtggtggcaggcacctgcaatcccagctattcaggaggctgaggcaggagaatggcttgaacctgggaggtggaggttacagtgagccgagattgcgctattgcactccagcctgggcaacaagagcaacaccccatctcaaaaaaaaaattataactaaaaaaagaaatattgagcaagtgcgcctgtgctgcttccatcagcccaagtcgggaacatggccatgtggtcaacgtgggcgggctgccagcgggtgtagcacctactggcttagagtgcctcatgggagagcaagggatgcccacttccattcagcactgccacccagggaaccgctggtgaggactgccattccgaggaccttcctgatgaccttgggccctctcttgctgaacaagccttaagggtaaaagttgttaaactggagaaggaagtccaggatttaatggtgagataccggagagctatagctgattgtgaaaacataaggaggtgaacccggagatgtgtggaagacgccaagatatttggaatccagagtttctgtaaggacttggtggaggtggctgacattttggagaagactacagagtgcatttctgaagaatcagagcctggggaccagaagctcactctggagaaggtcttccaacggttgtcacttttagaagcaaagctgaaaagtgtgtttgccaagcatggccttgagaagctgacacccattggtgacaaatatgattcccatgagcatgaatcctctgtcatgtgccagctggtgttgtggtgcagtctggcaccacggcattaatgagacaagatggttaaaaacttcatggctgcaccattagacttgcccaggtagaagtggcagtggagtctcagagaagactaagaggccatcaggaactgaatgttctccctgagtgcagctacctgtgtttcttttatttattaaagtaggtttgtat

SEQ ID NO: 137561 - DNA, 1057 bp, Homo sapiens
tagaaaaaatagctaatgtgtgctggacttgataccttggtgatgagttgacaggtgcagcaaactatcatggtacatttttacctgtgtaatgaacctgcacatcctgcacacatatcctggaacacaaaataaaataatgaaaaaaaatgaaaagaaaataaataaaaaatgaaaaaaaaatgaaaagaaaataaataaaaaatggaaaaaggaaagaaaaacttctcgagcagggcaaaacctgacatgatggtgcctgaagtgtcctagcgacctgatgtgagaaactcacttgagacattgccaccatgaaaacagctgaggaaacaaaggaacctgctgaagctgagatcactgagctgtgctgggacatgttctccaaaatggacatttatcttactggagaattgacgaccaccaatgaagactataagctcccagaaaatgaataaactactcagcttgaagtatcttgaaataaaagatatttctataaacattagtagatacttaaaggacttaagtttaagttcagtagtatgctggactgcagccttatctggatcagatcaatgtcattgaagagcaggtagcagctcttgagcagacagcttaaaagttaaatgcatttttttaaaactggaagccaagtacaagaagttggagaagcgatgaaaaacttatttgtatgggacaaagtcttttttaatgtggaagatgttttataagatgtgaatactgaggctgatgaattgtcaaatctccgcaaaatgaaactgtgctgaactttctaggaagatctcaatgttggaataaactgtaggactggggctacttctgtacctcctttgaggcagtaacccttgaaaactcacacataacttcttatttttacctgaatgcttcatcatccattcagggtagagaatctcaaagttcaagtaaaatcaaataagaggacctattttctctagtagtggttgattaccacattattttcctacatgactggtttttaagttattgtaaatgatttttttctgttaatgatgct

SEQ ID NO: 137562 - DNA, 1040 bp, Homo sapiens
cttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgccccc

SEQ ID NO: 137563 - DNA, 1072 bp, Homo sapiens
cttaaagccattgtacagtattattatcactataacctttcacagccttgaattacatagctcctcattatgctcactttctgtacctcacttctacttttcctaactactgtgtatattgatttgttctcactgtcactcttcagctgcttctttggcctttaaattagtttcacaaaagatatctatctttttataaagttatttaggaaagattttctgtgattgtctaaaaagccaaacccatattggataaactgcatttaaaactgggtgatttgactggaagtggtattcagaggaagaattgtccaggttcttttaaaatactgtgactaaatcaggcaatttttgagtcactaggtttttatttcaaaaataatttattttctttaccctaggaggtaaaaggtcagaaggggttgggtccttctggaataaaagtagggatcctttcatttggattgtttcagatttcctcattgcgtgtttaccatctaaactttatgtagttatacttatgaactttttcattttagaataaagaggaataacttctctgttcttccaggctgtcttattactactgctttgtatttatgtagcatctttcatcagatgaattcaaatagttattttttatattatgtgacatttcttaccatctttttggaattaatttttctttcaaattgaatactagttgacatatgggggtgtgacataagtaataagtttcattccacaggtcatatataagccagtctcattacttttaagttgctccttgcccttttcagggctgggtatatattatatactaatatatgtaatgattcttgctgagtttaatctttaaatgtgcacatagatccttatattctgtttctcttcctgcatacttttaggactatcattaactgttttttttttttttgcttattatcaatagatttaatcttggattacatagttgttgctgccaaatttgttcagatacctgtgagtctgtagaaacaaggaaaaaaaataggggtatgagaaaaatgagtcttagattttatatgtttca

SEQ ID NO: 137564 - DNA, 1063 bp, Homo sapiens
tttagcaactgaaagtctctgaggcattctaaaactggatgatatggcaaacacttaacattctggataacactggctgactgttctgttatggccactaacagtgtgacttcagtggaagaagagtatcttggttatccttgatttttggaatgatattttctctatgaatttccaggattggtcttccagttagcacttacttgaaattatattgacacaatctaaagaaaagattaagtgtttagttccaaaattttaaaagaaatgtagcaaacagttccaaagttttaaaaagaaatgtatcagatagacatctgggagctgaagcatacaataactgaactgaaaaattcactagagagtttcaacagtggactagatcaaacagaagaaatgccagtgtagtagaagacagatcattggaaattatcctgtctgaatagaaaaaaaaaggaaaagagtaaagaagcttaagggacttgtggcacatgatcaaacaagcaaatatatgcataatggagtcccagaaagagaagagaaagagaaaggagtaaaatttttatttaaaggcataatggataaaaacttcccaagtctggagaaacaaatggccagtcaagtccaggaaactcactgtgtccgatatgagatgaacccaaagacatccacagtaagacacattataatcaaattgtcaagttagaaacaaagaattttgaaagcagcaagacaaaaatgacttgtgacaaaaaagaaaacccataagataatcagggaatttctaagcagaaacattgcaaaacataagggagtggaatgatagattcaaaatactgaaaggaaaaaaaacttgccaaatatggatacaatgcctgccaaaactaaacttcagaaattaaaaacaggagtaacatcttcaagatggctgactagagatgccttgtattcatcttccttacccaagaagggaacacagcaattaataaacagctaagattttactgcagtgtcaaaggagattgttggagtgtagcaggagagtggagatgcagctgtggtt

SEQ ID NO: 137565 - DNA, 1064 bp, Homo sapiens
cgtgccatgacaccaggctaatttttgtatttttagtagagacagggtttcgccagttggccaggctggtctccaactcctgacctcaggtgatccgcctgcttcgcctcccaaagtgctgggattacaggcatgagccaccatgcccggcccattgttgttggtattcttaaagaaacagagccatgagtggttagtacacaaatagtttatgcagtaaataactgtggttacagttcattgttgtcagcaatacagcattttccatcacaattataggtgaaacaaaacctcatgaagtagtcatagcacattcatgctagcgagagcatattacaaagcaatgcacgtgcattataggggcagacaaaactggggaagggctatattttcactcacctctggttaactttgtgtattttgtcattaagacttacattatgtttgggtcaaacaaaaaacccaaagagattttataaaagtttacaaccattaaacagtattgtttaatcccacaaatggataaagcaaactactatagctcaacaatacacaaaccaggactaaaaatagtcaatctatgtatatagctagctaccatacaatagatattgaatatgctgagtctttacaaaggcattgactattttagacgagcaggttccagaaatacacttgtttgtttccaatgagaactaactgtagtgccatttcagttgaagactatgcactcctcagtgtcagacgtgaggataagcaaactaggggaaggcagaggagggttaggagggagacctgagcggactctttggacagctcagcattactttctctgtgcagatccagacctggttcacaaagtagaacaaagtgtattgaaatttttggccctcaaaaagggcatttgtacaaagtcccatacttacagcacagattgaatggtaactgagtgcctctcaaaatgaactcttctatgttagaagaaaactcagggccaaaggttaatggaaatcagtgtttgaattactgtataaagataatttattccaaaatagaaaaaaatg

SEQ ID NO: 137566 - DNA, 1267 bp, Homo sapiens
caagcctggccttgggccccttaaccaggtgttgggtgtgggagggatccaggcccccaagctctaaggccttgaaaggatgtcctgttaaggcagctactttcaatgtcttgggagtcaggttatgtggggccccctcccctacctcaacccaaacagctctgctttaatctggtttatctactagggctctgcataaaacttcatttgaaaagttcttgcctccttccctcccttcctcaactgaggagagggccaagtcaaccctggggcccacacgaagtcgtttctcggatttgctccagtctctttgtaaagccaggcaggagagtgggcccatcccacagatacacacatgtcaagcactcttggcccctccagagcctaaagctgcctccttccctgactgacctcccactctctcctcagcaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgtagttttggtgtttgtgagatgaagagggtgggtgctggggcagaccagtatagttttcccttatctgtggaggctccagacaaggctttgaccaggagctaggtcctgaggtcctttgggcctctggctttgattgctcctataaccaggctccacccatatcttattccggactcctcaaaccatttctgttctcagctgtagtatgaggccagctcacttggaagcatcaggctccagaggcattgctggctacagagcctagcgagtggccaggtggtttgcttagagcctccctgacagcgggaagagccaggccaccttgctgctacccagcaggcttcctgctgttctccacacctgccctcactatgcaccaaacagcagttgaaagccagagagaatattttctttgtcacttctgcactcttttggcctagaaaagatgagagtgggcttccctgtggtgtgcattagagccagagaaacatcttagggactgatccagagccccttctc

SEQ ID NO: 137567 - DNA, 1050 bp, Homo sapiens
catccagaccctccatgatgtgtccctgtgtgtgtgtctacagacagggaaataggggtgaagatgaaaagttgaagcagtgatacagcctggtcagaagttgttgtttgtgtccgtgtggaacatgcctggggaagtaggaaaagagcaaagagggacaaaaatgtctgtagttgtatacttgtatatgtaagcacatagagggggagaaggaccataaagaatgtgtggtgaagcactctggtggagaggggctcatgagaagtgataccgagagcagtgaagctggagatcctgagagagcccacctgtgctaagtggggtgggtggatggacagggtgagcaggcctgtgcaccagtcggagaaccagctcatcagcccagtcttgccacttccctttgctccacagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgagtgagtgcccatggcaacaggatttctcaccccctttctctgccacctgtgggagggagagaagacaaggtgaggtgggtgggggaggtagctgtccccagtcagggcctaaatgagtgaagtgtaagccccagtccctggctgggcccttgccagctctccctgtccctagtgtggggagccagtgaagtagccacacacagctgggcttggcatccctctcagattgcattcagtttgtgcttatggatggacgtgtgtgtgtgtgtgtgtgtgtgtgtgtgtgtgcaggcacacacacacattttgggaggagaagggtccatagctttcagcagattctctaactggtccaccactcctaaaaagtcaaaaatagatgctctcatccagctttttcacgttactgaggagaaaactgaggcccagaaaggggaagggatttgtctaatggtgcatagagtaatcagtaggcctccccacactgt

SEQ ID NO: 137568 - DNA, 1010 bp, Homo sapiens
tgttctgggtccatggtcctgttgtttctatgttctgtctgctctactacactgcctttcagaggcaggtctggaagttcagagaccaagttcaaaccctggagtgttggggtatgaagtggcttgagattttgaatctttcctaccccatccctccctttgctcagcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcaggtaagaactactttgtccccacatggacttcttttctctttggctggctcttgaggcttccttctaccctaggaagagatggaaagtagcaggaggtagccaatgtgaggcaagcctggaaggcagcctggtgcatagatgacagctggcttctcccacctcttaggatggagcctgtgagtgccagggaccactgtcaggctgctggctacctcacataagagcacattctgagaggatgacatgggtgtgagccctgggcagtaacatagaggcagaagatagcaagaagtagggagtgtgtacatatatggttctgcacgtgtttttcacttgcagtgagacagtgctttctgtgtatgtg

SEQ ID NO: 137569 - DNA, 2364 bp, Homo sapiens
gatctaaaagaaggtagccagggagaagagaaggggtagggtactgaagaatggtcaagataaacagactgcaagaactgagtctaaaagcccttgaccccatgatcccaggcatttatttccttctgtggatgtggaactttttcctgtctgtgtgttgaagtgtattcagacactactgctctcgttatgggccatagatcagcattagtgcttggtaagcacttgttcaaaacccactgatcccagcctctaaccagcccctgcctgaggaggctgaagcctaagatccaattgtcaactcccttcctccccactcctacccacccaccacccctcctccctatgctgcttcagccacttgagccagaggcattagctgctttggaggtgggtggaggagtaggagagggtcttctgccagcatcactttgctaaactagtgtcctcttgttccagggaggctgtgctggatgcttttctggatgatggcttccttgtccccacatttgaacagttggcagctttgcagatagaatatgaaggtagggttctgggggctcactgcacccttagggttctgattcctgggtggaaacagctggggtgggctggggggccctgggttggggtgtgaaggctgtttcctgccattccatggcctctgaaagtccctcagccttcctggctgagcagaacaggtagccccactgacagttgtggggctgcccttaagtgctctggaatggggtggggtgggatggggtggggtcggggagtcttaatgacattattgtgccatgttcgttgtgatttagctgctagctagagagctagaacagcagaattggaggggccttgtgaggtcatctagtccaacatcctcatgttacagatggtcagactgaggtccagagaggggaaggtactgacccaaagtcacacagtgagttattgacaaagctgaagctagaaccagatctctgttttgtttatactttattttgagtcagttgttggttgccagatactaactggtttctctctccccactgttctgctctcctctttcctttgttctgcggtggcaactctgttgttggtggggggcttggctcatgcgcgcgcacacattctcttgctctcactctcacttcctttctcttgctgtctcttgctctctctttcgtgctctcctgctctctctctcctattgcccccccaaatgggtgtcccttacaaaccagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggtgagggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggggatggggagggacagagccaaactttctgaggtgaaatgttgggtggggggctcactgcttccttctccttagatcctctcttctctctcaggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatgtaagtctcttgaattccatccggtaagagggtgaggcccttcaagcctcagggccacactgccctagaatgactgagttagaagggccctttggggacagtctagcccagtctcactcccactgacagatgggacaactgagtccagagaggggaggggtagggttttcttacctaagatcatacagcttaagacctgactgaactgagtccagtgtgggaatggataagacaatccccctagagtgcttagcacagtggcctgcacagagtaagtgcacaataaatggtagctgctgtttattattgaacccaggtcttctgactccaagcccagtgctgtttcctctattatctttccaaagtatacctctgatagttgcttagcaaccttcagttgctccctattgcctt

SEQ ID NO: 137570 - DNA, 2475 bp, Homo sapiens
ccttggacatccaccccatcccgattaagaatcctggatttagcctcactctttgtgatgggaaaacagatctagaaaaggggagacttggccaaggccatgtaactagctaatggggctgattcctacttctgccacttactagccccttaactgtttttggcatctcgtctctaagtccaataataggtttttttttctagaaaaagtgctggtaagcaggataaagcaaagaacagggggataacccagagtgaaagaggctgcttctggatatttgagatttgaaccttggagccaagccttttcctggggccttcctataatacccacaagatgaggctggaggcctgctagctgcctgcctgatcctgtggcactgcctgccttcccccctctaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatggtaggtgttttggagggcagaaagcggcccatgagcccagaaggctcaggcttagggttaacgctgtttatttccctggctcagcatttcctctggggctgtggtgaatcttagcttaaaaaattactgtcacaaaccatcctcctggctagtttccatagtataatggctgtcacatttgcctcacaaaccatcttgagccctgtgaagtagttggggaaggaattctagttcctcaattacaactcaagaaatgaggtgagagaggctcagaatcccatcaggagaaggggtctgggctggcagtcctatctgtctccccattctgttttcagaaagagcccgagaactgctggtatcatacgaagaggagcagtttacggtaagaaagtgccctggacttggtgtgctctcatctgccccagccatttcttccctcttgccagctacctgagagaagtcttgagaaggaatttgaaagaaaagtgacaaagcgtgagggaacttctcggaaagagagaggggggaactaggaaggagacaagaggagcagagtccaattggctgatcctccacaccgatggaagggaacagatgatgaagtttgcggataatctgccccactgggtggtagggaacaactgggaatgggtagttgcgcagccctgcaattccgcagctgaccagtagatggggcccaagagcttccctaaatcaggtgagctggaggggtgctgtttttagggaggtcactcagaaaccatttagctcagcccttccttttcacagattaagaaattgaagccatggatgagtgaagggacaggcccaaagtcacatatacagttaatgatagaaccaggattagtacctggatctcccagttatctttcttctgtaactcattgcctctcctcatctctggccctttggcctaagagtctctatctccagccaaattcccccattgaacatctcagtatttacccacaggaaattcagttggaggaggaagggagggagaaggaggaggaagtctcacatttgagagtcaggctatttttagttgcaaggccagtaggggagttgtgggcccccccctgcatgccctgccctgtcccctgcagggcagtgctgagaggtcctatgggaagggatcctggaggggtggaggtgggttgcttggctgaaccagccttctgatgggaccctctttgctggcaggtgctggagaaatttaggtatttacctaaggccattaaggcgtggaataacccgtccccacgtgtagaatgtgtcctggcagagctcaagggcgttacatgcgagaacaggtgtgtaactaggtaaccgggagctgcgtattctctaggatagagggtagcagcctcattgaaatcggtttccctatcctagcttgccaacctctgctgtacaaaatcccagggataatcctgatcccctccacagtgaccctacatttggcagaactgtctgccctcaaccctgccaacttccaggtgggggttgcctatactagaatggccagaggcaggaatgcccactatcatccatctgctggccagctgctttcctgtctgtcgggtggcatgtggagctcttgacaactaggaaaatcccttgataattaccacctcactcactgcctagcccttgtctaagtttgaggtaaaagatatatgtatggtgggcactgctagtcttgtcttgttttttttttattttttatttattttttttgagaaagtgtcttgctctgttacccagg

SEQ ID NO: 137571 - DNA, 1114 bp, Homo sapiens
aagcaggggtaaaggatactcagggagaaggacaggctagagggaggctggagaacgtgattgttaatgctcattcacaggtatttctttgttgtagaagggtggttggtggttaggggaggtgtgtgccttttatgtttctgattttcttttctttttttgagacagagttttgctctgttgcccaagctggagtgcagtggcgtgatcttggctcaccacaatctccgcctcccaggttcaagcaattctcgtgcctcagccacccaagtagctgggattacatttgtatttttggtagagatggggtttcaccatcttggccaggctggtctccaactcctggcctcaagtgatccacctgccctgggctcccaaagtgctgggattacaggcatgagccactgtgcctgacccacttttctgattttcaatacctcctccatagagcagtaaaaaaagaataagaagagctgtttttttttcttggctctgtcactgtgattggaatcttctttcaggacctcagtttctctagttgtaaaatggggcaggaggtggtcaggataattaatctctggctcccttccagctttaataattattttccaatttctgtactcacaccctcccctgtaatcaggtaaatattccggattggattgttgaccttcgccatgagttgacccacaagaaaatgccccatataaatgactgccgcagaggtgagtcctcagaggttatacctatcacagttaagcccaggggcctgggcttggtggcgctgagggtagagggataggcaggagggtctccacctggagtcaaggctgggactagggtgaaagaagtgaggcctcgccttgggcacaacatttaaagtggggagaagtcaaaagttccataatcaagataaataacatattaatgtggaaaaattcatgataaacataatatcaaaactttaagtaaaacgggattagtattactgatttctccttttgtttcagcttccaacatggcttggcatattttgataccttgactacagaggtttttttgcctgcccttaagttgttttttgtttgtttgtttgttttgagacgagtctcac

SEQ ID NO: 137572 - DNA, 1012 bp, Homo sapiens
agttgatttgggggtgaaagaaaggggtgtgtccacacaactgttgatggacagtctaccagttaggtgtcctgtatacggcctagtcagctcctcatgccctgtatactgttggatcccacagacattaccgtgtctcctcccaccttcttgttttgtgtctgttcatgctctcttgaaccagaatatgatgggtgtagcctgcaacaacctaggttctgaggtggagggtggaccagtgtaagggctctttatgatggtgctggactgtgaccctttaggtcaggcaacgaactccctctggcagtggcttctactgctgacctgatacgctgtaagctcttggatgtaactggtggcttgggcactgatgaacttagactgctctatggcatggcattggtcaggtaagacctgcatggggtaggggtggaggttggctttggggactggaggcaggggaggcatgtgataagcaaaacttggcttcaggtgttacctgaagcaaaaccctgcgtgtacctcactgtggatcagcctgtgattattgcttgacttatcagcttttggtaccctcgtcaacgcattcctctttttcttcctttttcctgaaagccttctcttccatttttctttctatcttggaatgtggaggaagggattcagaccaggtgatctctgtgggtctcttggtggtctgatattttttcttacctttgaattcctcacccagaggaacttgtctgaatggctcagggtcctcgcctgtgatttaatgtggactttccaaccctgtccctgtctattcctagcactacccttttccccttctctccctcatgaacactgaaagattgctgagttatggaagtggagacatgggctgggaattcctgacttacaaagtgactcataatggttctagctgtatacacgtcggaaaaaaaggttgctactgagttttcatatctgtcaaagtctttgcttatctatttccccttgtctgccttga

SEQ ID NO: 137573 - DNA, 1128 bp, Homo sapiens
tgttttactaggttaggtcctgattcacggcaataaaaatatacttaaaatcgcattttcagttcactggatgactacaatcaagctgccacccgccgaggggagcaaaataaaattcctcttgcagtgaagacataccgcttccggtctggtacagaagccggttagcaaccaggaaattggcggaacctagaggctgaactcttgcccctggagggtttgctttgtgaaaagaacacttccggccggtgagtttttaaccccgcatgtcattaggtcggcgcccaattctgacgttccgattggccatgctgacgctggaaggcgggcttgcgtatggggtcacgctctcctattggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtaaggtggcgggttcggcccttttgcctgcgtgctggtggcgctgcacctcttcctttgtcgagtttctataaggccctgttctccagtcttcccctaagtcgcctaaagttgtccctctcccaaatgcctgggggaacgcggcagccatctcttgcgctaatcccgttagcggaatggaaagtaaggggttgtgcctcaacaattctcttgttatatctgtgaggtttacccattacctccaaaaagtgactttctcccaacttggagaggatgccggagggactagtgaggcctgagccagggcttaaggagtagattagtaccctagggtagatttccgattccaatggggaggaagtcttgcctgcaagacagtgtttgagtggggcgcctcagtccagttggtaagattgagttgggagccgacttacaaggga

SEQ ID NO: 137574 - DNA, 3642 bp, Homo sapiens
tatatatatatatatatatatatatatatatatatatttaaaaaggcctttccccctccctaccttctttaatttttttcttttaggatcacaaaggctttgaggctttcttggatttcctaaaaaaagagtgttttgaattttcgagatgttcttgagtttctggtttccttccttgggatttattagatgttagtattgaaaaggctctccacaactataaagtccaattcctctcattgtatagatgatgaaactgaaactcatgttagggggagactaacctagagtgatgcagtatgccagttgcaaaactaggacttgaatctaggtcttagttagagggtcagtcttggtgaaacacctctttgatctgctggggttttagccatagatcaacagatcaggggaaaggcaatcgagtggtcatttgatgggaccatcaatgtgagcagacatagagcctagatccttgaagtatttgaaggtgtttgggtcggcattcagctaaactttaacagggactatgtggactgtttattctcctgccattcctagcattacttgagccactcgagtggcactaaagtggtacttggtaaataggagccagattcttagtcttttaacccttgaaccagccctgcctacagacttaagtggggggaaaaggatcaggaagagaggtcatatgagagaggatcctgcatctctccacttgggttcttcagttcacttggccctttgtgaaagtgtagatgatagagacagagcaggaaccatcttgggaatttcctttacgcttttcttttaacagccctctgggtagggagggggctggtggggcaggaaggcctttgtgggacccacaccaactaatctatgctctctcgtgttaggcttggagagggaaaggttgctctgtgagtcagtgatagaagtagtattgatcactaatcttctaactttccattctctagctgcctgcaacagtagcttgttttagggtgttgttcttacttttctcttacctcctcctcccatgaaactactttaccgaatgatggagctggaaaggacatttggaagtcatctagtctatttcccctgcctccaaatctaattctctctggatgagataatatgacagctacaattattctgaactctgttctagtgttgcatggcaacagcctgtcttaggtccctttgtatctttctgggagtttcccccactggaatttctagactcagggtccccagaggggagaatatctggctaccaacactaccagagttaggcctttcataaccatagctgctggaaatttggcattgttacagattgctaatagtctgtctctaatctttcaaagatagaattgaatttatcatgtgcctctttcctaactcagaatcttctttccctgccacctgctctattactttgcttgcaaaaaggaaaaaacagggtacagatgtggtctcctttgggatagtctgttggttcaagtgaagggggtggtcttttcatgactgactggctttgctgtccatccctccttccatttcatgcttgagagagctgaaaaacttttcaattccaggttctaatctgtggtatagaagttgtcactttggaggattagctcaggattccatgaatttggaaggtgggtgctgggaaatggaaagcatcactgaactgagaatttttcttctctttccatataagaagaacttctctcctgtcctcagtaaagtgagccaaatgaagtgggactttaggcaagtcctttcttcaggccctctgtctctccagcttgtcatgagggagctgtaccagtgatgggtaaactctaggaatccctccagtactgatgtttttgagaatcttgatggtataagagcattgagtctcttatatgtatgttcattccttcagacattctttcttcaacatttgggtaccttctatgtgccaggcagtattggaaatacaaaattgaacagcgcttattaaaatgtatcctcttgtcccattatacttcttgagtgctgtttcttcttaagtgctgagttcagaatggactgtttctcacatgggagttggtttgtttcattagtagatccaagaagaatactggcttgagtactcttggccatttcttcccgagtcatgggagagaaagggctgtgtctttccttactgtggaaagaaataaaccaagtgagagtatattatgaagactgtgggttgactgaaaagctttggacaaacactaaaagcctcatagattttcctgccattcttcccacatttttcagtgaccgcctgcctgatagtagaatagtcctttttatttctgctgaaaggaaggcccggaagctactagattatgtttcagattttcttctaacatggtgagtgtggtagttagatatattggtagatattgaggccttcctaagggctcctaaacaaacctcataaagtatctaccaccagtgagctgaggactggctattgtggggtacagctttttttttttttttgatacggagttttgctgttgttcaggctggagtgcaatggcacgatctcagctcactgcaacctccacctcccgggttcaagcgattctcctgcctcaggctcccgagtagctgggattacaggcatgcgccaccatgcccagctaattttgtatggggtacagcattttaaaggcatttgcatctagggcaacccagagcttccctagccttaagctttcctttagctggttgttctggatgggcagggtttctcacaggagtgttttgaaccatggaacaactgagctggccttaaatcttctgcctcagcctttatcttcttgatgggggcactaaagtccagaaaagggaaaggatttgagtgaactggtgatagtgccaggactaaaacctaacttgcttggctccagtgtaggggagggatggtgaatgcctaccttctaaatggcactcactgtgaggtgctcagtgtcttctccctctgtgctggtggtgacatgaccgtggagttatggccatgggaagagcaagttcctctgagtgtgtagagctgatctcatgggtttctttatttggaaatggctcaggctctgaccttgtctcaggaactctttgtagcacttcccaggaaggtaagtgttttgctttggcttgtgacgggtggtggaaggcatatgtgtaggctgaagggaggtagagagaggacactagtcacattttcctgcttgagactaggccttgctgtcctaagaaactttagagagtaatttcttcatcgtattcatagccagaggggttaggcagcttgttcgaggtcacatatagttggtaacagtattgaaaggagaacttggatttcctaattcccaagttagtggtctcccactggacttggctgtcttagaaggatgactccacccagagagcacagacttccagagaactggctctgtggtgattacattaacaagatgggtacaatggagttcccctaaaatggttttgctatagcaagtttttctgggatctccgatgactgtcttctcttcctgtctacccctcaccccagttccctgctttctc

SEQ ID NO: 137575 - DNA, 1100 bp, Homo sapiens
agagggtcttttcttcatgcttacacatgaactaaaccaaagaatagagcttggcaataactttatgtcagcagcctagaaacagcttttaattctctcattgactttgctataaaatcaggtatttgggaaagggtggagatggcagggaggatttctcagtgtgtggttgttagaggtggaggagtatgacgttttctggccagggcacagctgcagcatctgggtcttgaatttggagaaaaggccttttgggcgactttcaaagcacagccctttgtctgtgcctaatgacacagataccagatctgatgctcctttcaatcggcttgttgtggcataaggtaagtgttgacatagctcttaggccactaatatggcaaatggctctgtgcttgcttagtagaactgttttgccagttatcttctgtgattggtgacttcgaatattgaagtttcttcccattcctggcaacccttctaccttgtgggaatttgatagatactttgtgcatccagggtagtgatcagggcctaatgagagaagagttgagatatgacaatttggttgtacaaaacaagatataatcctgaaaatttttttcctgggtatatatttgggaagtgactggggccaaggcctaggagggggaacaaggcatacctgtcaggcttgatcagtatttctttccctctctttagccttggcctccattaaatacctgagaaggatcaagtcttatttttctcaagttgtgtgtttagataaggttcctgatcttactttcgtgatctaatctgccttccctccaacccatgatccatttccttttttttcttttcttttttttttgagacggagtcttgctctgttgcccaggctggagtgcagtggcatgactttggctcactgcaacctccatctcctgggttcaagagattctcctgcctcagccacccaagtagctgggactacaggtgtgcgccgccacgcccggctaatttttatattttttttagtagagatgaggtttcaccatgttggccaggctggtcttgaactcctgacctcgggtgatctgcctgcttcagcctcccaa

SEQ ID NO: 137576 - DNA, 1680 bp, Homo sapiens
ctttctgtctgccatagcctgggcattttcctaaggttgggagtttttttccttctggtcttaggccagttgccagaggaaaccgatgactaaaggcttcctccctgcaacgtcaacttctggaacctttcctgatgattcctaccagtcaagtctgccttatttggctattttctcccccctcaagttactccctctccttgccaccccacctcaactagtcctctgttctcctttagtacagggaatgccttcttcaagtttatacaataccacctgcaaacttcttttcttcttgtttagagtcctaatataggggaggagtggggaaggagagaggaagatgggagagctctggaatgactgtgatttctccaccctgctttcttatctccctttatcctcttggcactgcctggtcactcctctacagcttcttacctagatctctgacagcctaggagtggtctcgattggcctaaagaggttcagagtgtgggggtgggatggggctagggctttcagcatttgaaactatttctttggagcaggtaaagccttccagttggtaagtctagttctttaagtatgcctgttgtatgcctagccttctcacttggctttcctgggtgggctgagtctaagttccctctacctccccttcccagtcctgagctgtctaactttaggttagaagagctgagcttttgacacttacagcttggggcacttgtctgggtgtctttaaaaataccttttagtaaaaaatggtacaatggaaagaagagtgagatatttggtttttaatctctgcctgtgtgaccttgggcaagtcacttttatgaggcttaattttcttatctacaaaatagagacattggctttttctgacattctgattatttgtgcccagtctttaagaggctaggaaaggggtcttggaaagcgtgtagcagagcagagtggtgacttttcggagaagcttccttttcccatttagaatggcattgagtgtgtcattttctcctctggctatcaacatgtaagcagccccctctatttcagtgagctctgctctgggatatactgaatctacctaccagagagctcactgtggagattctggcttggagagacaactgttgactacatgccttgggtggggtcttggagtccagcctgcagactacagttgctggctatttttggtcatctgtgactcaggaagaatagaagacccttggattggtcattgttccatcagggaaagggaagacaaagaaacaagctaaaactgaggacatatgagatttcacttcctttactccctcccccacaacatccctttttgtagggctatgaaattgcttttgactgagtcttaaattgctaagctccctttccccttcctctatctgaatcattgttgactatgttgcccttggacggggagagctaggtgatatgggcttgggtggagcaaaagggagaatttctagtcaggaagattgccacacacctagtgttgggctttcaactgatcctgtattttgtaaatatggtttcctttggtattagtcctggagatcaaaggagagggacttctgaattttctgtgagggcctacaaggctgatagggaataagcaagtttatgggaaaggtgtacccttcactggat

SEQ ID NO: 137577 - DNA, 1097 bp, Homo sapiens
aaaatgggtttaataatgcttaacttgcatgtgtctcttgtccagtgtgctggtaaatgtttaacaatcaactcttcggcaaatccatgatttttactgtttgccaattcccatggtataaatactcccaccatggctgatttcaggttaccaatatgcagtccttgatggaggagttgggaagagatgtgcatgatcagctctagtgcaagctggttctagtgcaccattgctagtcacacctattttagactcctaccctcaccctccaacatactcacatctgtatgcaaatgcagcatcctctcaaccatgcctcttcttttcctcaagttccaagagcatcaaggaaagagagagcttcatttaaggtctgctccttgcctgaaagttcttccaggaaagagtgaatgtggagtgtttaagacgcagagaactcaagagggctttgagtggggccctaattatagcattgtgatcatcatgctttggctgctgaagtatctgaactgtctgttttctcccactgtttgattcttagctagatgggaggatggttgaagatcctggacaatggtctgagggtctggtgcacttagcgttctgattgtaatttcaaagtctcctcctcttcctgcctgcagaccttactttgctgggtgctaacctcaaggttcctgtcatggggatctctgggccagaaagcattttggatgaccagagatccctggtcctgttctctcatttcaacagcatcaaggccatgtgttgtttctttgaacttttcagatggaaagaatcacctgaggcatttgttaaaatgctaattccccagcgtcttctctggagagtccatttcagtaagcttggggtggtgtccagaagtctggactttttgaccagtgccaaattcttatggtaagctaagtttgggatatacctcattaagcactgcacaacactcctgccatggtggcatcattatgcccacgttacaagttgaaatttaagagttcatggtttattattggtagacctggatcttgagatcaggttttcagaatacaaagctatgttcctcttactacagagacatt

SEQ ID NO: 137578 - DNA, 1031 bp, Homo sapiens
tctagcatagccttcaatgccctccacttatcttcctagactctgccctctcttcactttgcaggcctcattcaccctggagtaggactgacttctaaagggaccatctgcatccttgcctccttctgggccatcatacatgttgttttctctacctgggacatttgagtgctcttgtgcctaccctcacagtctttcttttccacaatccagcttattctttggaaatcagtgcaaacactactttgaactgtggttcctaatttccacgaaaggttttctctgttcttctattatggcacttttcagggtctcccttgtacattttagtttttgtgtttttcagtaagtgccttgagatcagggaccggttctactggtctgttccaaccatagttccttaaacattgtgttccattaatattgggtgaattgaaatgaatttataggaagctccttaacctggggtcctcagacctctatggggtccatggacagaatttgaagtgggaaggatatatgaacttggatggaggaaaattacttatttgttttttaccaacctctcctttgtaatttagccatttgttcaattataatgtaggcaaataaaaataaaaataaaaataaaataaaggcagcaataatagcagtacccatgaccttgttaccaactcttaggctgtggagtgttttcctggattctaccctttttttaaggtttcttaataatagaagtttatacagaaactatctaatgtacttttttttttagatgaagtcttgctctgtcacccaggctggagtgcagtgacgtgatctcggctcactgcagcctctgcctcctgggttcaagcgattctcctgcctcagcctccagagtagctgggactacaggcgtgcaccaccatgcctggctaatttttgtattattattatttttttgagatggagttttgctctttttgcccaggctggagtgcagtgacgtgatcttggctcactgcagcctctgcctcctgggttcaagc

SEQ ID NO: 137579 - DNA, 1060 bp, Homo sapiens
ccccctaccccatcctaccacaccccctatgtcccttgggtatatgcattcattattttctgctgcttaaggattttttccatgggagctttgagaaatactggctcagatccgataagctggctgtcgggtcaaagggagccaataaagaattttctttttcctcagggataggaccatttctcagagtggaatgataaggaccctagtcactggagccacagaggttattcctggaactggaagctagatgctaagctctcacttgaaaataaggtttctctttcctctggaatggaggtctcaactggaagcaaagctggaagcaagaaaaacttggcttggaaaaggggtttagagttgcctgataaaatggttcacagcacccccatgggccttagagatttccttgtagcctggggtcaggagtcatccatttttgttctttgttctttttcagtttcaattctgatttcagaccatatttccttcccgccacgtcctcaatttctcactttgagacttcagtgcaggctgagagatattactcatctctttaagccctagagcctaaggaagtggaacatttatgtttctgatttctttatgttcacaaaggaagagacagtgctcagagagatcaccctccctccccccagcactgagcctgaattctctctttttttttttttgacatcactttaggtattactttgcccaacttctcctgagttactctggatctcagaactactttagtcaccatgatccttctctctctctctctcttttttttttttttgagacagagtttcactcttgttgcccaggctggagtgcaatggcgcgatctcggctcactgcaacctctgcttcctgggttcaagcgattctcctgcctcagtctcccaagtagctgggattacaggcatgtgccaccacacccagctaattttctatttttagtagagacggggtttcaccatgttggtcaggctggtcttgaactcctgacctcaggtgatccacctgtcttggcctcccaaagtgctggcattat

SEQ ID NO: 137580 - DNA, 1039 bp, Homo sapiens
tataggcacgcaccaccatgcccggctaatttttttgtatttttagtagagaccaggtttcaccatgttagtcaggatggtctcgatctcctgacctcatgatctgcccatctcagcctcccaaagtgctgggattataagcgtgagccaacacgcccagcccattttatgttcttataataaaatacctggagctagttactttatacagaaaagaggcttatttgtctcctaattgtagtggctgtaaagtccaagagcatggcaccagcacctgctcagcctctggtgagggcctttgtgctgtttcataatgtgacaaaaggtcaagtaattcacagggacaggggtccccatgactgaaacacctctcattacatactacctcttaatgattctacctcccagcactgccacaccggcaatgaagcatcaacatgagttttggtggggacaaaccacatccaaaccatagcactgctctactacttctgttccaagtctgttctccccccatgacctaatatcctggccctcatggtccatcttcttctcttcagcatcttcagtgggtcttctctctctctctctttttttttctctctctctcagctggattgtttcttggatcttgccttttcccaccaattgcatctggacacactattcttctgcaaccctgtggaaaatgattagaactgttaattgggccttgggccctgtttagatctaggatgatatacaaggtgctttaaaaaaatcttttctgttcacgcccacccactaccttcatcctctgcaaaaagccaatattacatttcaacataagcattcacatttctccatctgaaactttctggcagttccagctgcctattgacttagagtcagggaatcaactggccattgaattctggaagccttttgaactttcctcattacctcccacccccactgatcttttctaaacatgtttctaattatccacatcagcaagaggtagctgggaaatgggattgtttttattaaccatttgcaa

SEQ ID NO: 137581 - DNA, 1887 bp, Homo sapiens
ttaccaggggagttgccacccagctgtctaagattatgcaaattgatgatctttcagtgttttctccccaccctacagccactccattacccttaaaacctattttttgagagtccataacccttactcttcccaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagaggtgaggtggttccctgccctcctttgccttggccataaggggctgcagcccacagctgaccaatccctgcctcacagggatgccagatctgttcttctccattggggtctgtctgaagactgtgttatgctgctcaagagacatttgcatatagtgtcagactctgttgttgtttttctggctttccaaataaaaagcctttttgttttccctctgtctacctggttacagaactttattaccctggaggcaggtgcttatatagaaccagagattgagtaatttctttcacccatccctggttccattttctcagttctttttactgatttagatctcttatatcagaagttcacaggggagagagagaaataagcaaaccgaggacatggggagctcaaatagtcttttaatattgacagctagtgtacagagctttccccttttgtaaacttcaaagtcaaaagctctaaaacactcattatttttgtttttgtatcacaataacacacaaaatgaacaaagcaggcaatatccttatttcctggcgaaggaaatagaggtgcagaggtactcacactgactttccccatctggtgcagctcatctgaggcagagccagagccagacctggaagcttagcaccttaatattttaacactaagttttttcctactatacccaatggccatttccatagtcttttggattagaaggaaaagctttgcttcattctgggagcctcagtcccattggagttatggcatatatgtacaacacacccataagatattagggatagtgcttgtaccctggggactctacctgagtcattgccatgatatctgagatggcatgtttaaagcaaaccttgtttataatctagtaggtcttggaggttgggcctgttggtttttctgaaagccattaggactcagttcattgctctgtagccaaaggccatcctttcatttctgagcagtattcttataaacatagagtgttggtcctaagaggatctaggagagagtgtacctgactccatgaggtccatccctactgttagcccctaaagtcagcacaaactcctgacacattactgctatgcttagggaccacagcacatcatttgatttgtggatgaaggtacaaaggaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgcacagggactttgtgctttaaactactcatcacccattgtctttccagagtcctggaacagcacaaactcaacaaggaccagtgggaggagcggatccaggtgtggcatgaggaacaccgtggcatgctc

SEQ ID NO: 137582 - DNA, 1050 bp, Homo sapiens
ggtaagggagggtggcccaaactcacaatccctaagtgtgttgggaaggttgggttgagagacccagaggcagcaagccttggaattccccaggcttttttttttttttttagatggagtcttgctcttttgcccacgctggagtgcagtggcgcaatctcagctcactgcaacctccgcctcctgtcttcaagcaattctcctgcctcagcctcctgagtagctaggactacaggcgcatgccactatgcccagccaattttttttgtatttttagtagagacggggtttcactgtgttagccaggatggtctcgatctcctgacctcgtgatctgcccacctcggcctcccaaagtgctgggattacaggtgtgagccaccgcgcctggcctccccaggcttttgtggagcgttgttatcctgttctatccattttatctccttccctagtgctatgctggaaaatgagaagaagaagcgtgaaatggcagagaaggagaaagagaagattgaacgggagaaggaggagctgatggagaggctgaagcagatcgaggaacagactaagaaggctcagcaaggtgaggcttggagtcaccttggagattggatttttccaggcctaactctgagctggagaaccttctgcctgagctgtagactcagacaatgtagttcaggtgtggctacagactagaagaagaatgggcaagaagagagctcagaactttctgccagctttgtcttggggtggatcatttccaggaacgaagctattgtgtcgtctttatctctgtgctcttcactgccttctcccctccttttctgctcagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggtaaagctgtagggtgggctgggattatgggaactgaactttcttccttgtctg

SEQ ID NO: 137583 - DNA, 1455 bp, Homo sapiens
cttttttccttgttcagatagctttgtgacacttgagtgtctttcctgtacttgtcctgggaagactcttagtcgaatcctgagcattctaggatatcaggaaaggatctgccacttcaggaagtgacccaatgatggccaaagctttactgaggcccccagctgcatacttgccaagaggggcagggggagagataatgaggaagggacagagatggcatattgtttgtcttcaagaggcctacagtctaggtgggggagctctgacttaaaaggaagtggtggtcagggaagatgggactggaatgaagtagtctggtaaaagagtctctgaggcagcaagcaagtggagcagtaggtcccttactagtcccccaggggacttgggttgaagacacctgggtcctgaggaccagaaggcccagctctcacaggcttccaatttatccgtaggccttggaaatggcagagctgacagctcgaatctcccagctggagatggcccgacagaagaaggagagtgaggctgtggagtggcagcagaaggtaagacacagggcctaaagcaaagcattgaaggaatgggtgccatatgcataggtaacagctccttagattccttatgttttggctccctccctctttcatacttcccacagcaggcagcatgggagaaggcactcatggtttcgtcaaatacttactggagttctctaatacctctaggaagttggtacaattgctcttgttttatggatgaagaaactaaggatcaggcagatgaagtgccttgtcctacctggtgcctgcctcttgccagaccgttctaggcatatacaggatgccacagtttaactggtctcactgacagtctttctctccttctgtcactggacaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggtatacaagtagggccaaggggcaaggaaactatatgcattgatttagtagcccatggcattccctagaccatcatgggggataggtataagatcctgtcccagtgttgtatgggagcccaagccgttcttaagtgacagctttaaggataggcacctctcacttattaatcagaccttgggctatctcttccctttttgagattttctctctgccccacctcccactcactccattcacctcttacattaagaaaatatctagctgacaaaattcccacctgaatcttttgtatgttgttctactcttaaaggatacccattatcaactgg

SEQ ID NO: 137584 - DNA, 1021 bp, Homo sapiens
ctctgtgttcccatacatcctcacaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcac

SEQ ID NO: 137585 - DNA, 1277 bp, Homo sapiens
ttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcacagtgactcaatcgttctttgtggtatgagtgggtagctgtaagatatttcactgcagtttctatttatatattaccttcttatctttggtctcatttcatctatacctcagttctatggagaggggtgatatgactatccccattttatataggagagaatgggctcaaaaaagtataataacttcccaaggtcacaggactgtctaacttaatagtctgtgccctttcggtagttccaggccaacttttctactgtgggtgtggatcctgcattgaccatgtgatgctcctggacttgcctggcattgggacctaagaggtacttatttgtatctcttgatttctcttgggatgctcaggccctgtcctgcctctttgtcaggaaggtcttcaggcttttcctgcctcct

SEQ ID NO: 137586 - DNA, 1053 bp, Homo sapiens
tccagccaaattctcctgacttggaggttgccttggaaactgctggggaaagccataatgtagtacagcagaccactaggtattttagtactccacaagccatagatttattcctaaagtactccacaaacatgcaaccttaagatgtgtgaacatgagtgaagttgctattactcaatttcagtctgggcactgactgaatccttcctctcccctcccctccctcataggatttttgttgtttggaaaccatgtgttctggtttccattatgcctatccagtcaatttgatggagggtggggtatgcttggagcctactcagagaggtttctttcttttttcctattagatcttcctggagaaaagacattttaataaccttggctgctaaggacaacatgatagaagatgtctctggctatagataagtagatctaatactagttcggatatctttagggtttagaatctaacctcaagaataagaaacaaaagtacaaattggtgtgatgaaggtatattcctactgtttgggattgggctttacttattaaaaaaaaaaaaaaaactctgtcgaggccaggtgcggtggctcatgcctgtaattccagcactttggaaggccaagtcaggcagatcacctcaggttaggagttcaataccagtctcgtcaacatgatgaaaccccatctctactaaaataaaaaaattagcctggcatggtctcaggtgcctataatcccagctactcgggaggctgaggcaggagaatcacttgaccccaggtggtggaggctgcagtgagccaagatagagccacagcaatccagcctgggtgacagagccagactccgcctcaaaaaaataaataaataaaatgaaataaaataaaataaaaactctatggaggtgaagggtgaaggattgaggtgaagagtgaagggttatgctgtaacatacttcattgatttcctcagccctttatggctctgtcttactatgccccctattttgttggttatgctaatatttgtggaaagaggtcttgcatt

SEQ ID NO: 137587 - DNA, 6670 bp, Homo sapiens
tttaattccatctgcagagtctagtttgccatgtaacttaatgtacatagacataagaccaggccatgaagattatggcaagggagatggtatcaaaatcctgtttcccacaaaggtttctttttctctagagaaattgattattttctctgatccagtaccagctagcctcaatctgatacctgaatgtaagtatgtttctcaactgtgtcacctcagcctggtgctaggtgctctagaccccagggagaggaaggaaagaatcagctcccagacctttacctgtcttgtactcagtacccagtgcccagctgagaagagcccctgcttttgggtaacccagtggctttctgcttcgagttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtgagctggaaaggtggatcagaaaaaaacaaaaaaagcaaaacagaaattaaggactaacctcaaggaattctcttttggaatagtattattcactaggagtggaggaacagcagcaagctaggaacactttgggtggaggggcaacagtggtgatgctaaacttttaagccagacagatatcacacttctgggtctacaattgtcagggaactggcaaggttgtcatgataccagtctctccattctggtctttcgtaagctctctcagggccccactatctaatggtcatattcaggtatctccctttatgtgtgcaagcagcatagcacagtagaaaaagatatacaagccttgtcatctggaaaccctacatttcaaatcaaccttcattccctaataactatacaaaccttgtgtgtatgtcacttcattttacattttacagaggcaggaactgagacacagagagggaaagttagtttctcaaagtcacagggcaaattagtgggctagaactgtgcaagaacccaggtttgggggctacattttagagttggttcaactccaccattgcaaccatttgatagccaatgttactttctcaaagcttatgtagcatgaggtaggagagtaggtagattcccagttttcaactaaccaaatatcttgcagtgcccacttccgtatttcttcagttaatacattttcagttctcccaatgacttccctgctccctgcatccaacctaagaaaacgtgaacaaatgtatatttgaaagtcataactgatatcaaatttgaaagttataactgatgtcaaatcaatcaacttaggtaccttcaaggttatctagtccagttcttcttccaaggtttgggtccattttataatatccccactaagagtttgtgtagtccttgctcacatactttaggtggcagagggctgactacttctcaatgtatattacagtatacacaattgtgactggtgggtttgagctcaatgtaagaaagagctttccctgtagtacccgcctatccatcctggctctgttcctcgtgccagacagacctcatcagtttcctctgctttaagatagccctgcagaggcttgaagacaacaccacctctctggagaataccactttaggttcttctaaagtatgtggagcttagaactaaacctatcttcaggataaatggtttcaacaatgtagaatagggtagaattgtcatatccctatctaggtaatgtctttctgctattacatcctcaaccattggcttaacctatgatatttggaggggtagagaaagaagggtgctagtgagatttccccacatgtttctaacttggtttgctctctccttaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatccaaaaaccttgtttattcctctactttcagagaacctggtgaatcattttgctcatgtgtcttttcttagtgagcacagcaaaaaaatgtgtttctgatcattggacatggcatcagtagtgatgggattcactgacttgtcacacaggagatctgggttatagttcaagctctctttctttttctaaaattgtttatgccatttatattctcctctgagataaggatctactagaaattgttgtgttctaaactaatacttatcaaacagggttccatggtcctaagggaaccgtgcactgcacatcttctgaggtctgcaaaatctttaggaatttcagtgtgtgtgtgtgttttcattttgatcataatgtcttaaaatacaagcatattctagctagacctgttaagagtactgccttgccatttcaaggtctgtatttgtgttgataatcttaccaggttaaagagaccacctaaagagaaactatttaattttgaatgctatactttactataatttaatttaagagataggaaaatcaagtttccttccatctttaatattctgtaatctttacaacaatacatgttggcaaggatgtggagaaatgagaagcctcatgtattgctggtagaattataaaatggtatagcctcttttcaaaacagtctgacagtttctctaaaagctaaacttgagtatgatccagtaatatcactcctagatatatactcaatataattaaaaacatatgtacacacaatacttgtatacaaatatagaaacattatttataatatccgaaaagtggaaacaacccaaatgtccatcaactgatgaacagataaaaagttgtggtatatacatataatagaatactattcagtaataaacaatattgaacttctgacacataatacattgtagatgaaccttaaatcatgtcaagtaaaataagtcagatacaagagaccacatattgtatgattccatctatataaaatatccataaaaagcatgctaatcaagacagaatgtagattaatggttgccttggaatgggcatgagaaaaacaattaaatgttaataggcatgatggatcttatttaaaggataaagatgttctaagatttagttatgctgatgtcttccccactcaataaagttaataaaaatcattgacttgtatacatgaaattatgaatgaattttataatatttagaatattcctcaataaagctgttttaaaaatattctatgattactgatctctgatctctgagtagactgctattggtttactaatttactttcttaaaaatgttcattactagggctgattccataaccaatctctctctctctctcacacacacacacacacacacacacacacacactcacaacttaattgctcagttcagagcaaaagaaagagacagaacttgagtccttttccgttctcttctttttagtctctctagaccctatgtagcctagagaaaagagggagagaaaacatctaggcagaacttagaggaggacgatttaggaggtatcactcataccaaaggagaaaggacggaggaaaccactaaggcttaggggtgtgcataggaaaagatatattgggaaataactatcacaggctgtagaagggcttattgagggaaccactacagaatgggggagaagtgactggaattaccaggaggtaagaggccagaacttgtgtatttatcatgcctctatttgagaaaaggcattttttaaatcctaactgggccttgcattctcacttgataaaattatgaatggtggtacagtgggggaaacagaatcctctgatttatggatgatgataaaggcataggaagggttagcatttaggcaacacttctctgttttggagttgatttgtgtgtgcctgtgtcagtcaaagggcagtgagcccccactgtataccccagaaggacatggggaaccagatctctgggaatagatggatcaaagcagcaaacaagtcatcaaactgtcagacaagattcttaggtgattgttaataaccttttcattaggg

SEQ ID NO: 137588 - DNA, 3076 bp, Homo sapiens
gacagttcctgcttgtttttctatgtttctgtaggggcataagagcttgaagctgcctactcctccattttatctggcttccgctatcattcttaatatatttattccaaggtttccaggggtgtcagcatgcactggaaaatgaatgtatgaagaaaatttaagtatcacacaggacatgtttttgagtcaagcctgggaatggcaaacaatattagtatccatatttcattggctagaaatgatgcacatgcccccacttcattgcagtggggttaaagaattttggctaatggtgttcccaggagaaataaagaataggttaagtgaacaaccagccagcttctgctacaactagcatacaattaatatgctttcacaactagaattgtttctttgagaaagagctgtgactggtatcaggcaggagccttgttcctgttgaagttaggctgtcagatctaagaatctctagagagcatttatttcaatttcctcagtgttgggacttctgatgcccagaaactgggggtcggggggaaggaatatggccaaagttagtaccagagctgagacaagagccagctagagtgtttgcctctcatctataccattggcattcaaacattttttaccatgacctagagtaagaaataactttttatcacaacccaatatatactttcatgcattttatctgtaaaacttttataaaacagtacttatgtgggtagtgcttatgactatttgtcaaatatttcagctccccacattctgtcacattgtagaattgcattttcttgtacctgttgtagttattaatgatcatgtgatgtgtatggccaaggacatgtgagtaaagcaatatgggtcatttcttggggaaaactttaagagcttgtacgcagttcacaatgtttcaatcataaaagcagaaaaataaagcttctgtaaccccgggtaccccattgaggatgatgtacagcagagtcctcaggaaccccctggtaggcaaatatgatgagtgagaaataaacttttattcttttaagacactgagatttagggtttgacttttgccatactgcagcatagcctatgctgactgatacaaatacttagctttacttcattccatgtactcttatatttgatactattattctatttcattctattttatctttcaatgctggctggaagctagtgaattggttttatgacttagtaatggggttgcaagttgcaaaatactaccctgtacagtccacttgtcccacaggtgatcccatctccaagctcctataaagcaatattaacaacccccatctgtctacaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggtgagcttgctttatgagaccaagcttgtctgggcttttctagctgttggaggtttctcccatcctcacctctcagaacttagtcgaaatattcttcttataaacataatattcagtttaagctcccagaagagagaagtggtgtcttcccaagatacctctataaagtgcttagcacattgtcagtcacagatgagtacttgaccgcttttccatcatcactctcagctgaagaccaaagttcaaggtaaatctcactgtagacttaaaagaagttatgatgtacttggtatcaaagcagtgcacccctctcttgtggaattaggtctccttttggctacatggtgtcatgaatgggggaagaagtagagtgtctgggtctctgagtcagaaaaagacacagaggcagataactcagaaagaggggtgggcacttactttcaggttggcaagattcttaggagctgctttcccaggaagaactggtccaagtgcattgcttgtttgatcaccctgccattcctaattgctctgaacacaggttctaccgaaagacacgcattggaggcctgcaggaccaagagtgcatcccgtgcacgaagcagacccccacctctgaggttcaatgtgtgtacccagttctcttcttccctttctcctcatcccattgggtggcagcaagatagggtagtaaagactacccatatcccctcataccttttcatgtagagtagagtggcaagggaatcagattagaagtctggttttacaacatattatctttgcaactctatgcaaatcattcaatctcattgaacctcatttcctacttctgaaaaaagggtgagtcatgataatcatttttcttcataccttgtgtgatgggtatctaggtctaatgagaaaatggatgttaggaagcacttcacaaattataatatttgtaaacctatgagatattattattatatgaagtatataggagcccctagggctgaggacttgtaagaggctgaatgaagaactagggtccaatctatgcctataccactatccatttatctaatcgtctatcttttttgtctaccatctatttacttacttcctattttaaaattattgacatattttttaaatcatgaaagttttcaaacatgtagaaatatttttaagtgcagaaaaatataaaattaaaatgcaatcacccagcatctatccaaagttaataaatcatagcattttgcatatttgcttcagatgttttaaaagaataaagattccacagatataatggaattctcttctagattctctcagagtcctattacctccctacctcctcagatacaaccactatcctgaaattgtatgtattctgttggtaggctatgctaaagtaacaaacaaactgcaaaatctcagtgactttatacaataaaagtttattttttttttactatgcaaaggccttcctacatcatttgactgtgcattctagaccatatgtcttccaggtcaatgacacaggggaagagatggaggagacatactggttctt

SEQ ID NO: 137589 - DNA, 1047 bp, Homo sapiens
ttaagggtaggcctactagcaactcattctgttagttttcctttgcctgagaatgtttttatgtcccttcatttctggggatactttcactggatataaatttgcagttgacagtttttttatttcagtacttgaaaaatgtaatacttccttcttggcttccatggcttctgacagaaacccactgtcgtatcatttgaatgggtgtttttctataggtaatgccatttattcttggctattttcaatatattttttttagttttcagaagttttattatgatgtgtattggtgtgcattactttggatttttttctgtttgggatctgttcatcctctttaacttgtaggtcttttaccaaatttgtgaagttttcttccaatttgtttgaaaatatttttagataaacatttaaaaaattttcttttcataagattctgacaatatgatttttctatattttgttatagtctcataggttcttgaggctttgttcattttattttgtcattttctccctgttgttcatattgcataaattctgttgttctgtcctcaagttcactgattctatcatctgtctcttctctactactaagcccatccagtgaatttttaaaatttctgtcattttatttttaataattaccatctgtttatttaaaaaaaacttctgtttctttgatgagattttctatttttaagagaattttaaattgttttttaaaacatttttattatgggtgctttagaatccttgttcaatcattccaacatctgctttatctaagagttgctgtcagttaattgacttttctcattcatgttgtgattttccttattcttattatcatgggtggtttttcgttgtgttctggacattttgtcaattatgtcaggagactcagggtcctatttaaacttttactttagcaggcagtcatctgtttatgtttagcatacaggttttggcctacgtttgtgagctgcagttctaaaggctatttaatttccagaacctttgtagtgtgatttttggtctgcg

SEQ ID NO: 137590 - DNA, 1888 bp, Homo sapiens
agccagatacacatgggcatgagtcccatctttgctctgggcaaattatttcacctcagaatcaattaggatgtagtaagttgaaagtaacataaaatttaaccatgacatgaaccataagtatatttatttatgtaatgaagtctggagacaggcaacctttttgcttgttgggcagatcagcaatgttatcaaggactcagcctcttttcatccttcatattggacatcttgctgttttgttctcattgtggcctcatgattgcaaaactcaaagcatcatatctccatacaatagtcaaagtcaggaatcaggggcaaggtcaaaatagcttgccttttgtagggaagaagtcttttcccagaagctgtccaacagatttttccttatatcttatggtccagaactgggtgatgtagctatctttagctggaatagagactgggaaataagtatctggccaatgagaatgggattgtgtgattaagaccaatcaagaatccgttctggaggctagtcttcatgccacctagaatgaaatcagtgtttttatagtaaggaagaagaggggcaattgtttgaataagcagctagaagcatctgatagccttttttaaagtaacttttatttacttttaaattttactcatgaattataaacatcactgtaaataaatcattgcagaaaattaacaccatttcctcaggacatttttcttgatgtataattgccaagctaaataatgcgtacgattttaagactcttgaaatatatcagcagataacacttctgaattttgtttatactaatttctattaccattacatttattttcaacagtgcatagaattcctgttgtggccctctgttcggggtccctgacttcccacaacaaattcccatgtcccagaagcctaaacgcaaatgaataatagatattttcatgatctattaattttatgccttccttttaacagtaattactaatttatgaggactttatgagaattttggttttactttttatctatttgataggggaaatgtaccaactttactgtgtttatttgcccatttgcctttccaattttgtgatctatttctgattgtttctctttctattctttctattcattatgtattgttctttgtctactcacataaggaacctaagtagacagacatatagtagataacagagtattttaaaaatcgtttaaaatgtaagtatatttgtatttaaaaaccagaaatgcttttaaattttgtttcattttagtatcatctgttgatttgtaaatatattttccctttgatgtattaatttgatgacatgtattaataaattcctaaaatttaaatatcctgcattcccagtataaaccattcttgattatagttttaaggtaaatacccttttatgttgtataagttagtattttaactaaaacaaataattattattgtaacactatcagcatcaaaattttggatcagcattgtgctaccatggcaaaatcaagaatatcaatgttttctggctataaaagtggttaatagcaaaagaaattttgcaccttaatgatttgaaagaacttcctttgcctcctaattatgaaggagaattctcaataaatttttaatgataatttgctccttaatttattaaaaattattcatttatttaatttttattgagtacaatttgatagtctttggttttatttcactatgccaatccctgtcttttaattggcttacttagaacatttatgtttaaataatctttgatattttaagatttaaacctaacattttattctttttgtgtttgttttctctgtttcttttgtccctctatttgtcttttcttgccttcctgtggg

SEQ ID NO: 137591 - DNA, 1098 bp, Homo sapiens
gatgacaatctctataatgcttacctcacatggatgttgtgtagatcaaataataatagatgtgaaagtactttctaaattgttatgatctgttcacacatgagggattgtgattattctttaccccctgggcagaagccaactccttgtcttattactctctttacaaattcagctcctggtatagccactgactgtgaatttgagcaaattgcttggtctctttgcctcagtttcttcatctgtaaaatgttgctaacaataattcttaatatgattgtcttgagaatggaatgagttactacatgcaaagcatttacaagaactcatggcacatggtcagagctacataagcattaactcttttgtgttggcttcctcgtccctactatctcagatctagagaatagattaaggggacccagaagccaagtggcatggaagccactacttatagtcccttcccactagcttgctagttcttgtgttctctacccacagccttcccaccatggattgccaagaaaatgagtactgggaccaatggggacggtgtgtcacctgccaacggtgtggtcctggacaggagctatccaaggtaagttatcctattcagtacacttatttctgttgcatcttaggaaccagcccggcaactgaaagaggccaagattaggggagtcagccctacttatgactgatccagttcagcgggtaaaacctgggatccacagagtatgcaatagcagtcatgattccagcatgaagtcagcctagcaggatcaaggtcaagggaagtttccatgagataacagagtatttcaagaatagatgtgtaatgcagagacccatgaggactgttcagcattagggtaatctgtcatctaaagcaaggcccaaccacatggtgttcaagagccagatatcaggtcttaggaatgagaaagagagaagagccaagaagacctctgttctagagggtctgcgctactgaggaagctgtgcaatggagaatatagggatagggaaccacggagggtctaaaatcccaattaaagataaggatcagaataaaatgaccagcaaggcagagacttt

SEQ ID NO: 137592 - DNA, 1050 bp, Homo sapiens
ttcgagaccagcctgaccaatatgatgaaaccctgtctatactaaaaatacaaaaatttgctgggcatggtggcatgctcctgtaatcccagctactcgggaggctgaggcaggaaaatcacttgaacccaggaggcagaggttgcagtgagccaagactgtaccattgcactgcaacaagagcaaaactccatcaaggaaggaaggaaggagagagagagagaaagaaaggaggaaaggaaggaaggaaagaaggaaggaaggaagggagggagggagggaaaaaagaggggagagaaagtccctctgctcaatttggcaccaagcctgccttgcctagacagaggtttcaaagccatggttagagagacatgttggggtttaggacacatgatgtttattaggggggtggagctctagaaaccaaatgaaataggatgtctcagaccctcaaatgccagcagcagttgtcatggagattttaaacgcctatgttgggaacttagctcaaaaagagggctacttcttggttcctgccaatgtttttctgttttgtgggcaaaaagggatatgagaaagttgtccagagcagtttcctggccctgttactgtggtgcttaacttcctggtcatgaaggctatgagaatactgaagttttctgttctcaaggagaagagtgcatggcaaggggagggaagcatgcctactgaggccaacaccatgggccagcaatcaaatcagcacagaagacagtatgtttatcttatgcaagcatggatcttgtagcccactttcctttgaatgaaggaatgggaaagaatggcccagttgatgatgaaaaaaaggtgcacttatggaatgccatttagaatgacttaacctgtcgcttttggggaactttgagtggaggagtggtggcctctcaaggtacacatgtacactctcgtctcttctgactaagagtacacatttaggactttggcacttttagaaaccacttgaaattcaccctagtatgaagtcatgagtaagtaaagaacctcatgcta

SEQ ID NO: 137593 - DNA, 1053 bp, Homo sapiens
cagccacatgacagacaggcaaaataagggaataattctagtcatattgccacttgttggcccttgtaaacacaatcaaggtatatacaacacatacttggataagtttgggtgagaagttggatgaatcaaattatatttggaggcctgtgtaaaaatattcatagcagctttaacattttttggggggctaacttaagcaatatcctattggaataataaattcaaagtattaaataaagctaaagaaccatcttttaaaatgagatataattcacatactataagatttacctttttaaagtgtataattcactagttttagcatattcacaaagtcacacgaccgtcaccactgtctaattccagggcattttcatgaccctagaaagaaacatacctattcagcagtcacttcccatttccctttctccccaggccctgatatccactaaagctagtttatgattgattgcctattctggacatttcatgtaaatagaatcatacaacatttgtccttttgtgtctagcttcttttatttagcataatgttttcaacgttcattcatgttattgcacatgttaagcacatcattcttttctctgactgaataattttcattgtatggataaaccacattttgtttaccatttatcagttgatgaacatgtggattttccccactttttggctattataaataatgctgctaggaacatttgtttacaggtttttgtatgaacacatgttttcaattcttttgggtatttacacttaggagtgaaattgctgggtcatgttgtaacatgatgtttaacattttgaggaactgcaaaattaatttccaaaggggctgcatcattttgtattctcgccagcaatacacaagggttccagtttctccacatccttctcccccaggctggagtgcaatggcacgatctcggctcactgcaacctctgcctcccgggttcaagcaattctcctgcctcagcctcccaagtagctgggattacaggtgcctgccaccatccccggctaatttttg

SEQ ID NO: 137594 - DNA, 1137 bp, Homo sapiens
ttctccctagaaaaaaatggatagaccttgggtttctccctcaacagattctctctgaatatgggggagagatacagaaaaacctttttttctgactgcattttattttcaggtgaaacagacaaggtcagaactaaaagaaaagagcccttaaaactgtgattttcaacattgactgcacatgagaatcacttggtgaactgtaaaatgtagcgtgctcatgccacatttttgactaactacaacagaatcttaggggagggacccaggtgtcactattttttggcactcccaaggtgcaaccaagactgagaaccactggtctaagagattagccaaaccaactccctcgtggtatgaatggagaacttgattccagcattgggaagggatattctcctgatggcagagctgggactaggaccattcactatgctgagctaaaacaggaaatgcaaactttacaaatagtggggcagaaggaagatatgatgtttgatagtttggaaggaggttataaacaagataaaccttggatagaagtggccttgggtcagttcagaaaagggaaaggctgagtgccaacaccaaaaggtaaagcaacatttgaattacaggccaggcatctggaaatgatggcactgtacagtttagaagcttgattttcaagaaagcagtgttctcaaggctacgttgagcaacttctttgattctgtcttgtgcatgtgggtggatagatgggctcgcagtagaggaatgggcaaggcatggagaccatctgctgtcttcttcatcgtttttaatcccacacctcctgcactgtccaggcaaagcaaatatcctgaagtactgagttcttaatttagacttgtccttctttcctgcctacccatactacatagagagagcatgtttcaccccacaggcatgtgtgcaagttgagaagagcagcagccacaagctgcagcaaggagcagctgcacccccagcagcctgggtacctcacatccagcagaaacttggccaacatcaattattcagggcatgatgagctaatttggggattactattgatgtcagctgtattgtttctcctcttccctgtctgcttgcattcttaatcgtctacattatttt

SEQ ID NO: 137595 - DNA, 2828 bp, Homo sapiens
gttctaatagaatgcctagcatagaaagtactcatcaagtggttgctgagtgaccagaaattaattctccctatcttgggatgacaacagttattatatcttccaaacaccaccaaaagacatcatgctattctcaaaaataaaggattttccatgtaatatatggtggaatcagacactgagatgtcctacttccaggagattgttagtcaccgttgtggttaagccaaaaagagtgggcattacttcttcccttctacgatccacctctccatgacccagcccaccctttggaattgtttctgttgaggataaaatgagccattattgggctgtgggagttaggaaaaagaagctggagccttggtagtatagtcactgagtaattggtcctaaagctgggccaactcctttcttcgtatatgggaagtagagaagccactgggccctgaatatgcagacttgaattctacttttagctctaccattgaccactgtgtgactttgggaaaattctatcccttttctgagcattagtttcctcatcttagatcatcagggaatggggttaagttgtcctgaataatacttttaggatcccatgactatatgttttcaattatctgatagcttgaagttttaactggttgccaaagaggaggaaaaaaaaaacaaatgatggaatgtgctgtcttatgagtactgaggtgcctgttactaaaggacttcaagtagagctggatggtatttctttactgggcaaaaggccactgggactaagattaattttaaacctccctttgactctaagattgtcagagtctaaaaatggtctcaaagaatgtgcatttacatatgaggtcataggcttcttgttatcagtctcaccttccctccacaacctcacaaagtactatacctttctcccttttcttggacatctaaagaaaaaatgaagaaatattttggcagcagcatttcattttgtacagacatgcctcattctatagttctcattgtattcttccagtcctttgttaaggatgtggacctgggttgggcttgtaaatgcccactggtttgtatctctgctcctttaggatattttattcccaggcctatgaggatgggatggagtacttgattgccatgggaaaaaaaaagagactgttcttgttgacatcttcagatacagctattccagattgcttggtaaatgggacagggtggagggagtgtggggcaagaccaacaaacttaatagaaatcagaaattggagtacttgactgagttttatccagtcccaatcctgcaaataaatcataccatgaattcaatacccaactgggacaactcagccaaaagccttcttgggaagtcagcttatctccccttccagtactgctggttgagtaactaatttttttattataccgtaattttatggaatcttgtggtgattggtacatgaccagtgactcactttggctaggataacagcagagcaaagcaagaggtttcaggtgttagctgagtgccggtctggcttggggcttgtctccaataccctttgttccccagctctgggtgggatagtaacaacaatcatagcaactcctcacatacgtagcacaatctggagtttccacagcactctcacatacattatctcattttacccttgaacataatccagggtagtttctgtgcttttgctcccacttgggaagagtattttagcagtcagtagaagaacgttttccctcaaaatcagcctagagtttgctgttcttaatttcatcctatttcttttataatggtatctttgtattcttggctacacagtctcttttccccattcgtttaacaattatttttcagcagttgccaaacactaaccaaatatttatatttttaatttacagtctgctaagttgtatttgtcttttgaggtttgtgctttgtttgttgtctttgtgcacgtacgcatgttttgaaggcaaaacaattgactcatatggttagcatttacttttggccaagtggaagtagcccagttcagttggttattaattttgtctgtacaatgacaacagcttttagtaaggatttttttttctttttcttccccagctggggctttacctcttgctctgtgcgctagaataaaagacaaaggagaatagatgagacttctttaattttgcgcaggttcattctcctctgttgatatactattcctgacattgctgggccagatgttgctatcactaacagttaaaattcttcagccactttggaaatgttgaaagtagcccattaaaaactgtagtacccacctgtggtctctacattatgtctattccaggcacagattttagtatacttaaacacaaaaagataatttacttttatcacatgcccatgaaataaaataaaaatgacacatcctcagtcctggcctcctccacgtcccagtatcaatagctgacacattactcatcccttacttcttaaagctttgtcctattctactctatcaaggttcttttttttttttttcttctctggcttccccttcttcgttgctgtcatgtattcctcctcttccagcttcaagtatgagtgaccctcaatgtttggttcttcttcctctttcttcttccttccttcttccttctttcttccttcttcccttctcctcctcctcaccctcctcctcctcctcctcctgcttcttcttcttcttctttgtttgagaatctgtcacccaggctgcagtacagtggcacaatctcggctcactgcaacctctgcctccagggtt

SEQ ID NO: 137596 - DNA, 3478 bp, Homo sapiens
ctagggttgggagataaagaagagaaggaggctgggtgttagtgaaggcggggacagtggatcagacttgtggagcatcctgaggaaagcagaactgctaacccgcgtggcttgagggcaagtcagggcttgtgtaaagagcatgctggctctgtttgggggctttcaatccaccccctcacccgccgagcttggtttcacttgatctctcattcctggaagctgagccccgggcagtgttattttgatcctgcctcactccaaacactggccaagacccagcaagctgcaagaactgggggacaagaagggacccgccagag[450 bp omitted]catgctcaccatttaacttgtgttaccatggacaaataaaattacttctccctttctgagtttctgttaacttcaggctaaagtggataataatagcacccacctcatggggctgttgtgaggattagatgagataatccatataaaatacttgcacacacttagcacagtggctggcccaaaataaacactcaataaatattaactattattatttaagatagactgtggcacacagataagatttcaacaggtggagatagagaagacagtttaagcagagaaaataggaacaactgctttaaggcagggaagctcagggcatatgaaaagaacaccagctgagctggattttagagtacgattagcggaaaattggaagttaaacttgccaaggcagattggtggtaaactgcaaaagacagtggatgctagagttttgatttgatttagcagacaatggaaagccattgaaagtttttgagcttaaaaaaaacgtcagatcctctgctttaggaagagtaatctggtaaaaggttagtcagctggattggaataggaaaacacaagagggggataaactaggggcagagagggaacaaggccctggaactgaggtcgtggctgtgggaatagaaaggaggtgatgaatttaacaagccatcacaaaagttgaatctacagaactttgtagttgatacattatatggaattgaaaaaggaagaatgagaaaatcagaatcttttcgggttggcttagaccttacaaggttgtgcattcccatctcacttctgtggataacgcaatagaaagagtatgtaccttctgagctagacacagctattttcaagtcctgggtctgctatttatctgctgtttgtgatcctaagcatattatgtacttgacattcccaactaggatcggtatttccacaagacatttagaagtatgtggggtgtgtgtgtgtgtgtgtgtgtgtgtgttttacacacagtctgaggtactactgcatttaatgccaaacagatgcaacaaataattgttcctcccacccaccatgccagtagtaagcccaatgagaagtagtcaaattctttgagcctcagctttctaacctgaaaaagagggataacagtactcacatcatggtgttattgggaggattaaaagatatatttcctgccaagggtctagcacagtgcctgacaagtagaatttcatgaattgtaattttcctttaccctaatggattccacattaaaacatccttgccagtttctgcttgaacacttctagagggaggttccttactgcttcctgagagagcccactgtcttcagggaaagccttggactgttaaaagttcttccttttgctaagctgaacttagttttcctaaagcttgtacctggatatcctagtcattctccctgaggccacctagagcagtctgttctttttcttccatgacagtttttcagagatctgaagaccagagatcagatccccctgcatcttctgctcccaggtcaaacagctcagataattgtatcatttcttatctggcatggtatcaagtcaaatatgactctgtggttttgaagtatataaattggggtatgagtatgtcttcatagtgatgaggaatactgcaaaaggaacaggatgggtaaatgtgacaaaattccttgtaatttattattttttaaattatttttttctggtcaggaagggtggctcattcctgtaatcccagcactttaggaggcataggcgagaggagggcttgagcccaggagttcaagattagcctgggaaacatggagagaccctgtctatataaatttttttaaatagctgggcactgggtgctgggcacttgtagtgcccgctacttgggaggctgaggcaggagaatctcctgagcccaggagtttgaggctgcagtgagctatgatcatgccactacactccagcctgggcaacaaagtgagaccctatctcaaaaaaaaattaaagaatataaatcattttttccactatgtgctaaatactttcaaatccatcatcccactgattccttatccccaaatgagggaattgcagatttatttatatatattatacaggtggccaaacaggcctagagaaaatgaaacttgctagagatcatttagttagtaagcatctgtgccagaactgcaagacacatttttcttactccaagttcagtatggcttttcattttccacagctgttagggtttaaggtgatagatagctgggcaattacgccaactctggcactaaagaatgagtcaaaaaaaagagggatcctccaattaccttataccagttattccctctttgagagaattcctttctttagatgtcttcttgaccttctccacttgaatgcttcctgcagagagtgagtcatcttttggagccattcctcagtgctgaagcttcatattgaagcagaagctgcttttcactgctttctttctagaaactagctccacccgtgtattctcttcttgggagcttaacaggaaagatatgggtaagtttcaccatcagtatgtaaaatacgactactattattttgtgaacatagatatgaggatggctatactttgtcttggattagagtttactgtatatattttctatgttccccaccagactgcaatctcctaaa

SEQ ID NO: 137597 - DNA, 1108 bp, Homo sapiens
cctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggacct

SEQ ID NO: 137598 - DNA, 1046 bp, Homo sapiens
tacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggt

SEQ ID NO: 137599 - DNA, 1103 bp, Homo sapiens
ttgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtt

SEQ ID NO: 137600 - DNA, 1022 bp, Homo sapiens
tcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaaca

SEQ ID NO: 137601 - DNA, 1010 bp, Homo sapiens
ccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacaccaatcgtattttcttatttacaacagactgagagaattaatgctgttaacattggatcttttttcttttttttttttccttttttttctctctcgtttgctttccaggtcatgctgacctgttcagcttggactgtttcacatttgtttttaatgtcagtttaaatgtaattgtaaaagcatgtatgctctaaaatcatgtagttacttttttcagtggaaaagcctggtattcgaaagcatttccaggctctgcaatttcatatgagcaggtttttggtaaaatcttttgtccctcactcagggtggtatctggacagtgagcccctttcttctggctcagtagtcagagagaggagacttggagacagtttctgctggatcctgtgctttggcaaggatgtgcagcattgcatatcattctatcattaattatgtttactcctccatgaactaaaaaccattagactaaatagtccaacataaaccttgaaagataaaatttgatattcttttgcctggccatttctctgacccagaattggggctgggaggggattggagacttgggggaaagaatcaaggagccttcttgcctgggggaatttggcatgcacttattaatcccatttggttgcactccctactaatccctcactccatacctgccaaggattggctctgctccctgcttctcatccctgtcctagttcttcctcacctatctccatttcccactactgatccttctctccagtaagatgctattcaacccgatgaaatataaagagtagcaccaccctggaagtcaggataccttagttt

SEQ ID NO: 137602 - DNA, 1073 bp, Homo sapiens
aatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactac

SEQ ID NO: 137603 - DNA, 1087 bp, Homo sapiens
ccaatgttcagagagcagaaaagattccccttttgattctgggaattatgccgatgattcagaatgaggtgaaaatatccactccttccctttttctctctctagctggggctgtaataataattatcacagtaaaaatgatagcattttttgacagcttgctatgtgtcagacatggtgctatacatttgacacaaagcatctcctcgatttctcacaactttatgtagtatttacttacaggtaaactgcggtctacagaggttaagtttctatggactatcaaaatcaaatatctgtttttattttctttttggaggcttcgagtgtgtgtgggtggggaagaatatagaatcagagatttttgagaatcgaaaatatctccaaggtcatattgtccattcccctcaatggccagcgattttcttgtatcatatattttttcctttgctgttctcctttgagtggcctgaggtctcaggttggaacaccagagtctagataatacagtaagactggggccagtgtgccagagggccagataggtgtactttggcagctagacttaaagcagactgagcttcagcagtctggtgataggccaataggaatttcagaaaacaggaatcaattgaggagcaatgagagatcgggtggactttttctttgctctgagatttggagagtgaaaactgggtcattgctactttcttagattaagactccttaccaagaactctgaaaatgtccaggctacctctgtgagctcttcagatatccctagagtgagaataatggaaagaatggaaaaatagctttaaactagacagcccaggggttacatcccaactttatcctttactagctgggtggtcatctaaacaagccagtttacccccctgagccttgtttccctcattaaaaaaaaatgataccaataattagacatacttcatagagtttttgggaggagtcattgagataaatgtttcaagtactttgtacatagtacattggccactaaattttagtacttgcccctgccctataccaccacccctttgctgtattgacaggagatgagctc

SEQ ID NO: 137604 - DNA, 1050 bp, Homo sapiens
cagttgccgtttcaacttccttcagcattttgcctgttcaaatgcttttcgactgtgttgtgaaccattgtccttaatctgttagtgccagcatcacattttctagatgagaaaactgagggagagggcgtcagtacataggaaataaggcatagagaatcactcccaaaagttggcgattaaagaagcattgaaagttttggctgaggccactgtatgagtgcccctctccacctcaatgtgacccttattctgcatcatatcctgtgtggtgtagaggaaaaagattcaggggacttaacatcataatgcgtctttgttgaaacaagggagctttgttctttacttctgggctctctcagtgattttaacaggaatccagaggcagcagcacacttctcagtaccacaaggaaggtggatgggaataggtttccagctggaagtttatctgtgagacttcaggaacaacctgctgtgctcagagttctgactccctctgagacagtcttctcttctcatccttctcttttctatcttctattttctacatctttttagacctgtttctttgtgtgtgttttttttctctttttctgccttttttctttctttatgtctttgtctttgtttctgggtctctaatttttattgtatttcagtgcctatttatctctctgtctcttttcatctcattgattatctctctctctgtgtgtgtctctgggtgtctttctccgaatctctctctgtgtgtgtgtgtgtgtgtgtgtgtgtgcatgtgtgcatgtgtgtgtgtttgtgcatatatatgtgagaattttgctcaatccagttgcccagaaagccaaaccatttatctcttactgttctatcccagagtctgacaacctggattaccgcctaggagctattcactccctggtatataagctaccagaaaagaaccgagagatgctggaacttctgataagacacttggtcaagtaagtaactgctggattttcagaaaaagttcctattagaggactggcccatgtggttggactac

SEQ ID NO: 137605 - DNA, 1051 bp, Homo sapiens
ttggatcacctgaggtcagaagtttgagaccagcctagccaatatggtgaaatcccgtctctactaaaaatacaaaaattggctgggcatggtggcaggcacctgtagttccagctactcaggaggctgaggcaggagaatcacttgaaccagggaggcagaggttgcagtgagccaagatcgcgccattgtactccagcctgggtgacagagtgagactctgtctcaaagaataaataaataaataaaaacaaaaaacaaaaaaaaaattgcttgttctacagaagatcatttacgttttgtgaccatataagttgcaacagtggattgtttttatgtgtaggttttattgttaaatacagggactgtttccaggcatagaatatgaatcataagttaggatggacattagctgtgattatgataatacagcaaaggtctgtggtcctagatctacaaatgtgtggtgagaaatatctacaaatgtgtggtgagaaattagaacaaactggagatgggccattgacacatggactctgcctaagcgtgttagaaaaatactttgactccaagccttaaaatactcacatggagtcggcgctcacctcattcacacaatcatagagctccctggacactgaacctctaaagggaaaaggtctgccctggagcagaaggatcatggtttgcttgggagcatagcaggtaagctcagagctgggcctgggcctgggccagggccaggccctggcagcactgctacttgggaagagccacttcacctttgtatcagttattaaaaatagaatttggatcctttggtgaggttctcccaaattcatttgaggtgtccatggtcaactgcttgagctgttttggcaaccgcctgcccgaagtcacatttaggctgttcttcaccttgtttccaagactgaggaaaagaaagtagcctctgttttgagcaggtagaagtatacatttatttttttactgcaacttgctcaggaccatattttacaaaatgccttgtttcctttattgtttctggaaa

SEQ ID NO: 137606 - DNA, 1072 bp, Homo sapiens
tgtagatctaccacagccctataacaaaacagcaagaaagtgagtcacttaagtttttggtctactagcattataaactgccagctgtccgattcatagtaaataccatcattaatgatgtgtactactaacgcaagtctgaatatggatgcctttgtgtgaaataaaattcagccatatattttttaaatgtgtctggtaattgaactaaggtagacacttggtgttagcttacatcgtgggtagagaaacatatccttcctgttctggaagcatgatagaaattgtatttttaggctaacatttcacatatgactttgctcatgctgaaagcagacaattcaaagggctaaatataagtattttgtgttataagagttaaaatgttaaacctcccctgaaaaaatgactctttccatttaagggtgactagaaatgagcaactaaaaacccttagctctctcaatgcagtccctttgcatggtcattaaatgtttaataggtgacacctgttgcagcaggatctaactcttttcctttgcttgaaacagtggagctaaatgaagtgggcttcaagtttgtcaggaagtgcatcaatattattgagaccaaaggtaagatctgaaccatagtcttggcattgtctgaatctcgtcactctgattttatcctgggcaatttctctgaagtagcgttttaggaatgaagactgtttataaagcttgtgtagtagatgcaagctagaaaatttcagaaaattctaaactagtggtatgcaagcatatttggataatttggattcctgcttttaaagagcttataagtttataaagtattctcaaacagtacctggcactccttaagcagtgtcatgatggttctatcctaaatgatcaagagttcaatttctgccacagtacatactggtatgaaaattgatggggcagagccaaactcagggagatgtggaatcagcattcttcctggttgccgatactccctggtttccttctgaggatatttagactgtgggcaagtgtggtatgtgaatcaagtctctttgttctttgaa

SEQ ID NO: 137607 - DNA, 1026 bp, Homo sapiens
gagtctagagttgggagacagaaatgtttttctccctccttcatctgccactttaatggaagcttctttgctcagctaccctctgactttctaagggaggttttagacagccacttaccccgtcacaatttccctccccagaggcctcatgaaaattttattctgtacacttaatgccattcagtcagcccatttctcctacactccccttacatgatatgtattgagcttcctattaagtcttccgtcttgggaaagagtgctggatgactctgaacaatttctcctggtctcagccattgattcttggagcggggagaaaccatctgccatcttgctgcaaatactgtttgaagggacaagattctcagtgagtctacacattgctcctgctgccttgaccagacgccttccaagtgacactgaagacactgtaggaagcagaaacagcttctgtgtctttttttaaaaattgcctgttaattcttgtttcatatcaggggcccttggacttaacactgaagtactgtgtgagaaggaagacggagtctatcgacaagaggttctgttttgacatagaaactaatgaaaggtaagctgtgccgctgtgaattggcaatgtccccacgtgccagatgcttagcctgggtaggtcttttattttcctccgtcatcccacgttgatgacaatgagtaagtctattcaggactttgttgtgagtctattcaagccagctcttctggctgcccttcccagggatccctgctagacctggcccagtgctgcttttctctgtgcaagcttctatcagctttgcctcacttgctctgggaagaaaaagtctctcctgggatttaatttgctatcagatgtgcaaaaggtcaacatttggtgatcttgcaagaaggaaaggataacaaagctcattctttgttaaatctcctaatatcacataaaagaacaaatgaattggcacacatttttgagggagggaagatggggtggagggtcgtggtgttattaga

SEQ ID NO: 137608 - DNA, 2009 bp, Homo sapiens
ttcggtgttaaaaaggaatggagaggaggagacagttaaaagagagatgtgtagagtcatgtacaggttagaaggggcataacccaatgaccaatgacatggaacagttatagagacagcaaagtaaatgacaatagtctccagcttctgggatatatggtgatacaatttatagggaacatggcagggagagtaggttttgagcaagccagaagcagctgtgggaagcagttggtgaaggttagaatctccctgtgtgcagtaggtaggtggctatggaaggagggcggtcagggcaagggcagggctggatctgaagtttgactctgaagagcaatgtgtaaatagcttccatcttagggttgacttcctatacagctaaaatagttattctgtctgctcacttttacttgtccttgtaggggctttaggaatatcctgggtgaaatactattgccagtatgagaaagagaccaaaacactgaccatgacgcctatggagcagaagccaggtgctaagcaggtcagttcttgtttgcaccatatttttggaaatggatctatgactgtttctcagaaaagaatatatgttgacctagtatcaaatcatcaagttcatcactgttacgtgaggccatgactttatatgtacaccttggcctaagtttgagtcagatagcactgagttgagtgaaaaatttctctgttgattagagcaagccttttgaaagtgccggtagtctttcaaaccagttatttttacaagtgccagtcacattgtacagtcaactatgtaaaaatatggatgaattacttttaagaatgctctactcttggattctttaaaatagcaagttttaaaaatatgaattgaattccaaaattccttttttacaggagtgtgtttatggcccacagttggaataaccgatactcacattctatgtactactcaaatatctttaagcagttaatctctctttttctgccctccaaaccttctctcactcctgaaaatgacaagataaatttaacacactgaaaaaaatagtttacttacctggaagaacctgatcttttacaaacacacacacacacacacacacacacacacactcacacacactcacacacacagatacacacatgggggttccttaagataaaagctgatctttagacagattgtttatattctaaaagtagttcaatgtgcctctttcccctttaactggctctcagacagggtcttagtgcatgatttttaagcatttgcactctttacaaattgtttgttggaagtgcttcaagggttatttgttagcactgaaagtagtacatgaagacccaatttaggtagggaggaatttggagaaaaattgggacagtttctctcccttgctgatccttttcatggaagatctctcttgtgtggcttgctcatgttgaattagagaggatggaaatgtgctttcaggctactgaaatttttttggagtgagagtggtcttttaaccacaagatttagctccctgctttaatgtgctttggtgatgggatggacttgtaaaagatgttgtatcaaacagagtttctggaatcctcggctatgctttattattattgttattattattattattatttgcgatggagcttcactcttgtcgcccaggctggagtgcaatggcacaatctcggctcacagcaacctccacctcccgggttcaagcgattctcctgcctcagcctcttgagcagctggtattacaggtgtgcaccaccacacccagctaatttttgtatttttagtagagatggagtttcaccatgttggctaggctgatctcgaattcccgacctcaggtgatcctcccgccttggcctcccaaattgctgggattacacgtgtgagccacggtgccagttactgtgcttttatcatgggccagttactcattcaaaaccctcctcagtttccagtccgccagttgccaaagcacctttca

SEQ ID NO: 137609 - DNA, 1073 bp, Homo sapiens
gtaaatgttcaacctgatatgaaaacagtgatgtgtagactggtttgtgtttgactgcgtttagcgctatactgggtaaacaccatggagttttttgttgttgttgtttgtttgtttgttttttgtttttttgagacagtctcactctgtcccaggctagagtgcagtgatgcaatcttggctcactgcaacctccgcctcccgggttcaagccattctcctgcctcagcctcccaagtagctgggattacaggcgtgcgccaccacggccagctaatttttgtatttttagtagagatgggatttcaccatgttggtcaggctggtctcaaactcctgacctcacgatctgcccgcctcggcctcccaaagtgcagggattacaggcataagccaccacacccagccacaccatggagttttttggtgagttcatgtttcttttatttagtttattagaagatgctggtgataaagttatttttacatgttttccctaggtcttggcctttcttcatagtctgttcatttctaacagcctgactgtggagctcacacaggatttcctcccatacaaacaacagctccaactcagtttacagaatgtgagtttgcatgtggatttttctcaccggtctttccattccgattgaatttcagccctagcgaccttgattcttggaattctaggttactgcatcctagccaatttgttagaatatactggtgtggatcacaaatatttagtatatcagactgttcttgctcttccactttcacatctttcctgtttttgaggctgactgctgttcaaacccacccttccacacaccaacaccttcatctatgcaatatttattaagtattgctaatttgctgcatctctctcagatcaggacatagctataggcttatttgagcccaggccttaagctacttccctgctcagtcaaaacactctcactgtagactttattaccacaaacactcattttatcttctctttcttttctcagtacttattagtagagtcacataaattacttttaaaggttttctctaccttctttgtc

SEQ ID NO: 137610 - DNA, 1025 bp, Homo sapiens
atagtagcatgcttctgttcttgggctttggcccttgttaatttcttattctctgtattcatgtctctgtagtgtttgagggagcagattttcctctgacttcagttctctgttgaatataataaaatgtgtggattttacacttgttcagcttttttctttttgtcagggtggatgtaatgacttcaagctttttatgtgttggaccagaaactggaatcctgtatcagtcacttttttatctcttggctttaggttctctatttctaaaataaaaggtaacatcactagttggtggctaaatgctcatctagctctagcattctgttcaatccttaagtactgactttcatgaatgaatatcccaatatgtaatgtttgttttccttcttctacaggcagacctacaggtggacaaggagaggcacaattttttcgagtcctctcttgattatgtttatcaaatccaggaagttcaggagtccaagaagttcaatattgtggagcctgtaagttttctctgttgatgaatggtctaaaaatatttatcaaatgcctggtaaatgtacaaactttgatcataaaaacagaatcccaaagaacgtgaaggataatcagtggaaatgtctagaacgtagtctaacttacgtttttcttgttctttagtatactttttttctctctttccccccaacccttttctctctttttctatggctattttctttctctttcctttttttcctttctctttcctccccccttccggaatttctctacaactcttcctgttactttgtttccctcccttccttcttcttgcgctttcagaagcttctgaaagtctttctcatataccagatactatgctagggactcatgtctcttgcagtcagtgacttctcattctactacttttacttctgtcttgtgtagttttttcccatttcacgttttttcattccatttacttcgttttgtgtagatttttccatttccatatatttgtttgagacagggtctca

SEQ ID NO: 137611 - DNA, 1091 bp, Homo sapiens
ccttgccttattgtgcattgttttgaaaattgccctcctagccagccatccctgctctaatgattcaccttcaaactgtgatttcaagtcttttggatcttcttatgccatgtgttaggcagcctctgacattcagaggggctcataaatataggtatgctatggtagtatatttaggaccagttcttttgcctccttcttacccatatgcctttaatcagcttctgctcctctggcaatatgggcataattggcatgtgttttcagcagagctcattatagagatttccattgcagcaggcaattttgtacaagcccctgtctgacattattaccaaagctattgccgttgttttgtcaggtctaacaagtccagcaaggtctggctgattgaagcattcattgaattggccactgggcaaggaggcggttgcttggcagttcttctcttcagggagggtttccttttttagtagcagtcttacctctaaggagtcagcagctccctttagaactggctttcccaaagtgtgtttccccacccttccacccagtggcttccagttgttctgaaagctgctggtcaactgtgcctttaatatttctaatggcaggagttaataatgtgatgtttaatagaaaacatgtgtcatcctattggcacaccagagaaggcagctctggtctctccattaaaccagcaaagatttttgttttttaatggtgataagtagaaataagtatatgggatacccacaggtatcttttactttgaagtcttttgtagcttctgcttttgagaataactgatagagggaaacttcttagccttgcacctttgctttttgctcctttccagaagtcctgggcagaagagagaggggataaggaatagtcacttgaggttgggcgtggtggctcacgcctataatctcagcactttgggaggccaaatgggtggatcacctgaggtcaggagttccagacaagcctgggctacatggcaaaactccgtatctactaaaaatacaaaaattagctgggtgtggtggcatgcacctgtaatcccagctatttgggaggctgaggca

SEQ ID NO: 137612 - DNA, 1090 bp, Homo sapiens
cccaagtgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacaggtacctgtcctccaaagggacggaggctatgagcttccttaagcgggtcgcgcgctcagtccgtcccctctacttcctctactgtgccattgatgctctcggtctttgtgtctttcccctttccccctactcccggccatcagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaagtaagtgcaaggcttcgatgagctgtttctctgagctggtgtgtctggcctttaagcctttccacaccaccaggggaagggagattgcagggtgactcccagcccagatctctgaggcaaatgggtttcccacacttggggagtggagatagtagaagtggaaagtggtggatacaaccagaactttgggccttttcctttagtggttttgaccttataagacgtgatccgtagctgtgccagggaccctcttgctcagcaattacccttacttggcagatgattgttcttaagggacaatctgctgtactgttagacatattcagcacccctgtctggggcaaagtgacatccaagctgaccaaggaactgccccagcacctcctaaacaattggggattaaggtcagcagcttgaataataattttgtcctggtctctggttgctacagataagtgtggggggcagtaaaaaattcgccatggcaagttattttttaaggaaagcacctttgccccagtgaattattttctttatcacactgagctat

SEQ ID NO: 137613 - DNA, 1067 bp, Homo sapiens
catgctggccaacatggtgaaaccccgtctctactaaaaacacaaaaattagccaagtatgatagcgggtgcctgtaatcccagctactcgggaggctgaggcaggagaattgcttgaacccaggaggcagaggatgctatgagctgagattgcgccattgcactccagcctgggcaacaaaagccaaactccatctcaaaaaaaaaaaaaaaaatcaatagccctaggttctggtcccacctccacatataaagctaggcaagtcatttccttctcagcttcattttttgtatttgtgaactgagcatgattatacttgccttgtctaatgcagtctctgactggtaaagtgccttggctatagtctttttttcttagaatatggggtagggaacctaggtctgctgattgtttgtccattggtctttaattatagcgtgccagcatgtgtcttagtagatggggagaaggaaagggtgatttgtgggatatgaaataagcgaaactggaagtctatgtaaagaagtgcattcaggattaggggacagggagggcaggtggtgggagaggagaggtaggaaggcttggccagccaaagagagccttgatgtctgaattctaggagggagagaggtagatattagaataaagacagaaaatattaccttcgcttctgtcttttcttgtcttgtaggggatttgtggggccctttgatcctttgtgtgacactcgcattgtaagtacttgcattttctttctttgtcatttgagctagactagacttttttgtggatttccaaaattgtgggggattttgattgaatatttcatttaggacttatatgacatgttgtacatgttatactccttaggtatttaagcctctaaagtcactttccaaatcaattaaaatatgatgaaattaggctcaccttccttaaccaatgacattttagtctgttttagccatgtctattcaacaaacatttatttacttatttactctcctgttcctccctattattaaactaagtgaattaaggtttaagcaccctttgtttgcaa

SEQ ID NO: 137614 - DNA, 1053 bp, Homo sapiens
ctatgcctggctaattaaaaaaatttttttttttgtagagatggggtcccactgtattgcctaggctggttttgaactcctgggttcaagtgatcctcccaccttggcctcccaaaatgctgggattacaggcatgagccaccatacctggcctcatattttgttttaaagaaaaatcaaactaaataagggccaaagagaagtgttcttaaaaccactaccactgtacagagataaccttgttaagttaaattatcttaaattatcagaggtcctttgataagcttcagatgccctttccaggccctgaaatcataggcagacttttttgtgtaagaagagtatgtacgttttggggggcaagtggtccctagcttttaacaaattctcaagtataataggtctataaactagaaaggattaagaaccactaccttagaggttcagagaaagatatctgtaggaactagagcagatcatctggtgttagatgattgacttttaaggaatttgagaggagaggaggaagagtatggggaaagaaaattaaagcatgtacttaattttttttttttttgagatggagtctcgctctgtccaggctggagtgcagtggcacaagctcagctcactgcaacctccacctcccaggttcaagcgattttcctgcctcagcctcctgagtagctgggattacaggtgcctgccacaatgcccggctaatttttttttgtatttttagtagagacggggtttcaccatgttggccaggctggtcttgaacttctgacctcaggtgatccacccccccacccttggcctcccaaagtgttggtattacaggcgtgagccatcgcgcccagccaaaagcatgtacttaataattaatgttaggatgtagatgttatgtaccaagaaggaggcaacattccgttacatagagaaatctatgtaataagctgtgtcataacacccatcagttgtatttatgatctttattaatgtattttgtttttaagatctttttttcagagcctctgtgtgctgggttac

SEQ ID NO: 137615 - DNA, 4983 bp, Homo sapiens
gatgccaagctcatgaatgtttagtaaatgttaatagttgtgacaatattactgtattaaacattcctttttgttttgtcttgttttgtttagcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctctttt

SEQ ID NO: 137616 - DNA, 1124 bp, Homo sapiens
ttttcctagctgcctttattttacatcactgtgcaaagtagataaagctgattatcttatagctaaagaaataggctcagagaagtatgtcctgggttataaagtcagtctcaagaatgcaattggttgttcctcatgttaatccaatctttcattttctaatgagaatgcaaaagttgaagtgaattcaactgaattgggaaatggaagaaattagttggctaagatgagaccaaattattgagagtaggtattgaaaaccagggaattgtgaagttaggtcttactgtggtgggaaatagggtgacttcaaggggaatatcttgatgaaagtgacctcaaaggaataaatgggaacatggtgggaaattggattgggaggaaggtagagggaagaaaagagtgtgaatatatttctaagctgtaagtctgaagtcgggaagaatggcgggctaacagttgtggaggtactgactttggctgtcacagtggtgatattctacagaccactgaaaataggcgcctggagggtagtattatagaagtcattgctataaatgtaaatttgagcttacagatgtgatgaatattgagagaacactgtcccaggcacagtcttgatgacaaccacagtgctggatgatagacctatgaaaaggagccagaaagatgaggaggaagttatgaagctaacacttacctaccatggattttcacattgctatcttcatctaacactaaccctgtgagatcattccctccatttttttcagaagaggaagaagtttggattcaataccttgcccacagtaagtggctgaggtggaatgtgaatacaggtctgtctgaactccaaagccttggtgctttctgctctgctgttaccaccatgcccgattaatttttgtattttttgtagagatggggtttcgccatgttgcccatgccaatcttggactcctgagctcaagcgatccacccatctcagcctcccaaagtgctgggattacaggcatgagccaccacacagccaaatgttttatttatttaagtaaaaacatggaagtgttgatgaatgtgtgtgtcgtccttctgcaggggccatgctaatattctccctatcg

SEQ ID NO: 137617 - DNA, 1093 bp, Homo sapiens
caagtagctgggactacaggcatgtgccaccaaactctgctaattttcattttgtacaaaaagtacaaaatttttgtacagggttttaccatcttgcccaggctggtctcaaactcctgaacccaagtgatcctcctgcctcagcctcccaaagtactgggattacaggtgtgagccactattcttggtctctttttttttcctttcttcctctgactggataatttcaaggggcttgtctgtgagtccattgattcttctgcttggtcaagtctcctgttgaaattctttagtgaatttttcaattcagttattatattattcagcagcaaaaaaaatctgttttattctttttttatatgttctattttttggtgatattttcattttgtttatgcatagttttcctgagttcactgagcacctttgtaacagctattttgaattcttggtcaggttgttcatttatcttaatttacttttttcaattttataactttatttgatgtttttgatgatcagtgatgtagttctcatccacattgactgtctgtagattttcgaaagtggtaacaggtacataggtaaccaaagtatagagcttgtttggtgaatcttcatcctcattacattttctagacaaccgcacatgggtagggtatgggacattccttattcctttggcccagacagctttgttgaacctggtgtcaatgcgcacatctggagttcccatctccttcatggcaaatttccgaatctctttgagtgcccgaggggcacgcttcttgaagcccactgcatggatgcgcttgtgaatgttgatggtgtaccctcgggtcaccatcttgttgatggcagaacggccctttttcttcttgtcatccttctttgcgggagccattctgctgggtctaagttggaaaggaagctatcttaatttctttagagttggtttctggagatttattttgttcctttaattgggttatattaccctcttttgttgtgtggcttataaattggtgctgttttctgtgcatttgaaaaaaatagctatctctactggtctttacactctggctttgtatgg

SEQ ID NO: 137618 - DNA, 1058 bp, Homo sapiens
caaggtgggaggatcatttgtgtccaggagtttgagaccagcctgggcaacatagggagaccccgcccctaccaaaaaaaaaaaaattagccaggtgtggtggtacatgcctgtagtcccaggtactcaggaagctgaggtgggaggatggcttgagcctgggaggttgaggctgcagtgggccgtgatcgtggcactgcactccagcctgggtgacagagtgagaccctgtctcaaaaaaattaaaaaaaaaagttttgaacagagcgttggctctggagtctaagcacttagatttaagtctcagctctctgcttgttggtcagatcagcttcagcaaattctatcacccctttgaccctcagttgtctgctctgtaaatgggatagacatgtcctcttctcctgtctcacagggttggtgtaagggccaaataagaaaagagattgaaagcaccttggaaactgtaaggggggccctatttatctccatgcttgtcactgcaacttgactgtaagcatctttgaaacagaaacttggcccctcgagggctgtgtccccattgcctcttgttccagtttgtccagaatgggaaggtggtgatgccgggggtatggaactgaatccccagagtcgtgctacacctggagatgctgatgctctgctcctgccctggttctgggtacacagctacttgaccttcctttgaagccaaacccagctgagaggaccatttttctaaagttacttggcttgcaaaatgctgctcctccaccaagtgggcactggcccagcctcactgccccagtgtgctttcattactttgaaaattctgcaactcttgtttcaccccctctacctccttcagctcctagttcctcagattctggctccaagtaatgatttcaaagttccccatgccccccacccacccccccaatgtatgatacatatatatagagagagaggaagtagaaagatgtggccaagaaaattcaattttctgaatggatcagatgtaaaactgttggaaattacagctagaaagctctgcagat

SEQ ID NO: 137619 - DNA, 2443 bp, Homo sapiens
ccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtga

SEQ ID NO: 137620 - DNA, 1102 bp, Homo sapiens
tggaatgtgtgaaagttttctcttatgttgaacttaactgtgcctccctgaggcttctaaccctgggttccgagtgtgccctctgggaccacctggaccctgtctgctctctctgaccttcagggatctgaggatggaacccaagtgcacctgtgtcttctctaggccaaacaaccttcaagcgtctgcgctccttctcagacctggagcagcccccttcccagcctcatcactgtcctctgtcctccctacatgctactgtttatggcccccttaacatgtgggggcaggaaatggggcactggaaacccctcactccccttagtttatttatagtctgaacttgttcagatgacttttccataatccttttctggttaccacaacaggtagactcctaacccccagaatcttgggtgcaaataccttagacaacactgatttgtttatggttcaggtccagccagctctcacgattggagagcccttggaaggtagggccttcttattggtgcccccatagtggaggacaagcctggtgttagtaggtgttccccttgttgagttaaatacaatgtaatatgtggggggcttccagcgtaccctgctttcctgccactcggttttatctttggagttggtcaggggtgggtggagggaaggggatattttagggagtactgaagccggaaatgagtatgagccatgcccacagtggggcctagaagagtgaatcagacagtgagaaataccaacgtagccattccttcccctggcagttgatgatgatgactatgagtcctcccatttcttcagttgccaaggcactttcacttccatgattccattgtgttcttagagcagccctgtaaagtagatggtatgatttccccagaatgatctgtggtggtctccacctgaggcccagggaagggaagaacagtctccagtgagggaggatttggagcccaggtctcctgaccctcagccctccctgttttccccaaaccacacccagcagccatggcagccggggctgactcggcagcttccccaccacagaggaacccctgccctggctgcaactctgttcctgtgagag

SEQ ID NO: 137621 - DNA, 1042 bp, Homo sapiens
taggatttcctgtcctttatctgggctggccaaaggctggcctgtctgaggtgtgagataggcacctgcagccagcctttctgctccaggctgaggtcaagtcaggctgtggcagaggcagtgagcttgtgggaagagcttgtccccaaacatctgtcctgagcagtgcccacaccagcagggccttctaaatgggaaaaacagagaggggaatgtggaaaaggggtcagagtggagcagaagtaaaatacgtcctgagctgtacacaagctctcatgttcacagtgctgggagactttgggcaaattacttaacttctctgagccttcattttgtcagctctaaaatggagatatgtacccacctcatggagttgttgaatattaaatccaacaatataaataaaattattgccattattgttgcttggtagtaccttctgcagtcctgtcatttggttgtttttcactgacctgggggtgggcagttctcaaacctgccacctcgtgggcattcggtctggactttgcagtcatttcagagtccaccttacccagaaaagctccctttggccatgcccacccacagggctcccttcctctggccttctttagtggcattcgcgacactcaacaggctatagtagtgatggtgacaccaataataatagtgaactcttctaaattcttggcaaattttaacttctttagcattcatggcaattccataaggtaggtactgctatctttgtctctcttttatttaataaacttgcccaaggtcacatatccggggagtgatggagctgggatcaggacccaggtggtctgactccacctcctgacatctttaatgactgggccatgcctctctccagatgcctggccaggaggcaagagctgaggttcgggtctccttccccacctgagtgctcatcacacgcaccagtgatcagtcacttctggacaggcagtccccaggtccttgcctgtctgctctgtgcacttcttctcaccctccatcaccaaggtggacagatgga

SEQ ID NO: 137622 - DNA, 1021 bp, Homo sapiens
gatctgagaagcagtttgccagggcctagcatttctgagcagcagtagcagggcctgcagtggtaggcgactccttgcctgcctcctagccctgccttgagggaccagcctcacagagcctgccttgggaactggggttgtcacatagatagtggcatcacaggtctttctccgccgctcaggacactggcttttcctcctgcactcactgaaggtgggagagacaaacatggagaccagaccctgttttggaggcccccatcctctggcgagggccacggaggagatgcttttccaaataggaagctaagtcaggtaaaggaggccaccacgtgtttaaagtcaccttaaggagcaggtcagctaactcaatgaccttcacaaacaccgactgcctgccttccctcagccatcatagacattcacactgatgctggtcactctccctgctcctgcactcaggtctagagagaacgtgggcctatgaatagaacaggcctgtgactggtctctgggtagaattttccagggacctatatctgtggctttctagcaggccttttctgtttagggcggtggtctttatctcaggctgtactttagaagaaccgggagagctctcaaaaacaaacaaacaaaaatgaaccctatccccagagagtttaatttaactagtcatgggtggggcccattagtaaaagctccccaggagattttaatgtgcagccagatttgagaggtgagggaggaatgggacgggacacccaagagctccagcagtaataaaggatgctttcatctatgtccctgtgacatccatccattgcttgtcttgagtcctgtatcttcccgcctggtccccatgcctgatactgtctttatgggtaggcatgagcaggctgaacccaggaccgggcagctctcttataacccactgagtgaccagaaggtacaaggactagggttgcctagtagtggtgtgaagagggggtacccagcccaagagtggggttggtgatac

SEQ ID NO: 137623 - DNA, 1034 bp, Homo sapiens
aagccctatgcttgagtgtttctcaagaccagaaggcctgcttttttcctggttgcatccttctcagcatagaaaactgctctgtgctgtctctgggacgtggcctgtgtaaatgtaggtgcagatactgtcattgacctcagaaagcatgtgctgctgctcagcctttccttctttgatgctccctccaggagacctgtgggtttggctctgaggcctgattggactctggagctttctagtatgccctctcccctgactctcccagcctgggtcatctgggcccctcccccaggggcttaagtctcagtggaatccagtttgtgccagctgactgctgttactgacctatcctggcacatcacctaagctttggccagagcatgcactgcctgcagaatatagcctttaaaactgctggcagccatgccttggaatctgcatatctggatacagaggtagggcaaggggccacagacattcctacctcactcacctcagcctgcccgttgtcactctccccaccagatacataagcccatcctcagtccgggccacctgggcttcagccccaggtgaatcgagtctactgggggtgggggtggggtcgctcctggcctcagcctgggtaggctgagacgagtgggagggacaaggcagagcacctcagttcagcctttaatcaccaagacatatgtctctgactgatccatctgggagggagcctcggggcctcccagccctccatgagatggtgtattgtggggagccaatgtccctgacatcctgtttggtaataacccattacattctctagattcctgttaaggagggctggtggggaattcagtctgtagccctactccaaactcctttgctcctttgtctttggagcaattgcagcctctttgaaggctccttacctcacttcccccagccatttggctgcaattctgacagtggtctgggcaaagccattgtccggacccacaggggaacgcagcagctgggcttctttctctaatttcctcttt

SEQ ID NO: 137624 - DNA, 2630 bp, Homo sapiens
gcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattgtgtgtgtgaaatgagagttggctgtcaaagtgctgaagaatgttagatgcgatgatgagaaagagaatgataggaatggttgaacatttctacttcctgcctgggctaaggtggtctacccagggccttggaagggggtgagtccctcagaaaggctcgggggtggacacagctgtggcttcttatcccagcaggcctccttgaccccagatgatcctggttcctgggcagggggtgggagagtgggaggggtttggaacaggcagggaatgagactcaagaaagccagggccaggatgcccagacagtagggcttggggagcagagggcctcctggctggctatgacttggagcaaatgtgctaggacctctggccttctcttgccattgctagatcaccagaatgagacatgtctgcctgctggggttgggcagcatgcacctagggccctggtgtcagcaccctcctaaccccatttctttgcctgtttctttcccttgttctgttttagaagccgaggccaaaagagcatgtgagtggcttcaagcaacaggattccctcagtatgtgcagctttttgaaggtaaggccactcaactgtttaccctcccatacttcccctagccctcagttt

SEQ ID NO: 137625 - DNA, 2020 bp, Homo sapiens
cccagagctagctctccccacctaggccatgttctcagccagaaagcagggcccttcacctcagagtcccccaagagtttggaagcagagagtggagtacaagcaaggacttgtggcctgggcttctctgacctgatcctgcagtgcctttcccagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggtgagagtttgggttgggatggggcggacgcagggtctcctgttctctctctgtctctgaagctgatttctcagtcatgaggcccagggctaagtgcttggcggctgcgttatcccctcacagccagctcaggagagagagtacaggacttgggaatccagaaagttaggtccagaacctgcctgtgctgtggccttgaggaaatgatgctctcctctctgggcctcagtttcctcatctgtaaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccct

SEQ ID NO: 137626 - DNA, 1048 bp, Homo sapiens
agccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtgagccctcgtggggcagcctgccgggagatggtgcaggggtggggtggtggtgggcattgggctgaaggctgaggagctggggagaggaactgctctggccttccccctcacttgggctggtccaccagaggcctttgctgttctcagcaaggaccagcaaggatgaaactcctttctactccttatgcccagctctgtgctaccttctttctggcccaggctctgtagtccttatcttctgggagcctgaatttgcctagatccacctttttctactcatctccacaaaagcatcttttttcttttgtcctgaagctgtaaaaatccttctctttggttttcccatttgtctcctaccctgcccctcaggaggcctgataagctttgaagtctctggggtggcctaggctcctgacacccagtctagggctggcctcacagtctgcctcctactcatgcatgttttcctcactccctccctcccctgcatggagtaggtaggcatcttccgcaagtctggggtcaagtccaggatccagaacctgcgtcaaatgaatgagacctcgcctgacaatgt

SEQ ID NO: 137627 - DNA, 1081 bp, Homo sapiens
cggggaggagctgccgcctgagtctcgctgtgcctcggcctggtccttggagaatgtcagagagtcaagaaagtaccttaaggaatcaagaaccaaatgagaccaagggaactctctcaggaaccacctgccagaatgaccttccaaaagccccgttccagatacgatgctgctttgatagcctcaactcccatctctccctgccccgcagtccagctgaatccttgcatttgcacctttgtgcggtcctgctgcctggactgccctgaccccaagcattacgtctcccgagtcacctttagcgacaacggaatgtgttcctcctccattcagaaccttctgtcatgccccaggatggaggggatttctctctgttcccctctgggcactggtcatgctctttcttggacgtggattctgagtaagattgcaagcctgaagtgtcctgtgtaaaaaaatggtcataacaaaaccttccatgtaggatcagggtgagtgtgaatgcctggtacatactaaaggttctgtaagtggcagcttttgttgtgcatgtgttttactgcctgtgctagatggcaagctccttgacaatcaccatcttcctgcacctccaagcactgtgcccatcatggtagggcctgagaggcctctgagaatgtgtgccccgtcatctctttatgctgtctaacagactgaaaagcagacatccagaaaagagagagagagggcagggagcatgggagcactgtctcagtctggccagcgctagcagaggagctctgcagcctaccctattaagcctcaggccctgcagtttgaggcctggacttagggctggagtcagagttctccagccctgacagctgcccccatccccactcctgtggctcacaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcac

SEQ ID NO: 137628 - DNA, 1076 bp, Homo sapiens
cctgggacagcctgctcgacccccttggccttgaccccctcccctgcctctgcccctactttctgccccatgctattgatccctggggctggggacaagtcctttcttccttctccctggtgagggctctggggaaaaatccattgctcatgcctggtttcttctgcttccctaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcac

SEQ ID NO: 137629 - DNA, 1056 bp, Homo sapiens
accatctccactgtctattactgtacctgtaaatgtccgtcctcctacttgtctggaggtccaagatgcagctaaggcaagaacagcctgcacagcaatgtacaagcctggaacactgaaggactcaaacattacttcagcagtatattccctgttttctggagtattaagtcgaggttcagacaaaataaaataacggtcttcagtttctgcccttaaatatttaagatgacttgctctataaaactttttgtcaggtccaacttcaactataccatggcggattggccactttgttgcatatgtaggttttttctactgcttcatcaccaatgaagaagtcttggtcatcaatacttttcatcaccctcctttgagattgatcacccacttttggtgactccttagtagcaatacaggaaaggatgatcaactgtggttctatatttctggcatatcctagttttgtataccccatgctacagtccaccacacaggcctgcagccctcccaccatttccctgcttgcctgcttctgctgccgccactgtctgctccatgctgctaggggacagagattggtggtgggagacaggggctatctgactgaccatacacagctgggccgccctcaccatttggtaggtagccaggaagcccaagcagtagcaagaaagcagcaagctcagtcggcagccatcacttctgcaacccaggcaggcaggtagtcctcttttttgggtatctatatctcaaatattttttctctgaatgcagttacctttttattctcttaattcattttgataaagagaagttcttaaatttagtggagtctaatttatcaatctcttcctttatagttagtgctttttatatcctgtttaaaaaatctttgcccacctcaaggtcatgaatgcatcctcctggctttttatttcctagaaggtgctttacctttcatatttaggtctatgatccaactgaaattaatgtttgtatgtgatgcaaggcaggagataagggtcattgtttttcccatgcaggcagccaatt

SEQ ID NO: 137630 - DNA, 2447 bp, Homo sapiens
acattaatttcagttggatcatagacctaaatatgaaaggtaaagcaccttctaggaaataaaaagccaggaggatgcattcatgaccttgaggtgggcaaagattttttaaacaggatataaaaagcactaactataaaggaagagattgataaattagactccactaaatttaagaacttctctttatcaaaatgaattaagagaataaaaaggtaactgcattcagagaaaaaatatttgagatatagatacccaaaaaagaggactacctgcctgcctgggttgcagaagtgatggctgccgactgagcttgctgctttcttgctactgcttgggcttcctggctacctaccaaatggtgagggcggcccagctgtgtatggtcagtcagatagcccctgtctcccaccaccaatctctgtcccctagcagcatggagcagacagtggcggcagcagaagcaggcaagcagggaaatggtgggagggctgcaggcctgtgtggtggactgtagcatggggtatacaaaactaggatatgccagaaatatagaaccacagttgatcatcctttcctgtattgctactaaggagtcaccaaaagtgggtgatcaatctcaaaggagggtgatgaaaagtattgatgaccaagacttcttcattggtgatgaagcagtagaaaaaacctacatatgcaacaaagtggccaatccgccatggtatagttgaagttggacctgacaaaaagttttatagagcaagtcatcttaaatatttaagggcagaaactgaagaccgttattttattttgtctgaacctcgacttaatactccagaaaacagggaatatactgctgaagtaatgtttgagtccttcagtgttccaggcttgtacattgctgtgcaggctgttcttgccttagctgcatcttggacctccagacaagtaggaggacggacatttacaggtacagtaatagacagtggagatggtgtcactcatgtcattgctatggctgaagggtatttgattgccaactgtattaaacacattccaatcccaggacgaaatataacatattttattccgcaactgctgagagaccaagaagtaggaatccctcaaaaacaatccctggaaactgctaagacaataaaggagcactatagttatgtctgcccagatttagtaaaggaatttaacaagtatgacacagatgggtcaaaatggattaagcagtataccagaatcaatgctatctcaaagaaagaattttccattggtgttgtttctgagagacttttgggatttgaaatctttttttcatctagagtttgccaatccagactttacataacctatctcagaaattgtaggtgaagtaattcagaattgtcctattgatgtcagacggcctctctataagaatatggtcctctctgtaggttcaaccatgttcagtgactttggatatcacttgcaaagagatttgaaaagaactgtatgtagatgcctggctgaaattaagtaaggaattgagtggcagtagattgaagccaaaatctattgatgtacaagtcgttacacaccatatgcagccatatgcagtttggtttggaggatcaatgctggcttccacgccggagttctaccaagtatgccacactaaaaatcattatgaagaaattggacctagcatttgccgtcacaatccggtgtttggagtcatgtcataaaaatgacttcatagttattggggttagggaggtggagaagagataatctttttcattatgttttgtctggatggctggttttgaggttttaaacctgacttgaaatagtaagaccaaacgtgattatacagaaatattttaataagtgtatcaacatgcaaatgtagaagagaaagaaagtgattgtattttttttagattgaatatttgaatcgtatgtgtaacaaaagaagtgggttttagttccttctgtgccctggtattttgtatgttaatgaattatccaagatttgatggatttatcagtgtgtagatagctctataattatttaattgtatacttctaagtgtgcaatgcaagagcttgtttatatttcatactttttgtactttgaggattaaaaagtcaaagaaaaattgtgtttgagagaaaagtcatgaacaagtaaaggataaatttaaaaaatagccccatgagacttggcatacacactaatgggattccggttattatggagtgcttccatacccctccactccttctccccaaaaggttttctttgcaagtgcttttgaagctaagagctgatatcttggattaactgatgcctgctgctgctttctgattactcacattctgtttcttgcttttaaaaaaacagtaaagacaagagtgttggaccagtattgcagttctgtagtgtcatt

SEQ ID NO: 137631 - DNA, 1020 bp, Homo sapiens
cagctccacagctggaaaggagccctcctgcagagttgggggtgctggaagaaacacgatctgtctgtgcttccccctttttgtgctcagagactttagtgctctggactggcttacaggttttggggggtggtatcctctctgacccccctcctcatctacctcaagctgagggcaggcattgtggggtgaggatggggggtggctgaagactctctagaaactgtccgaattccattctgtaattgggtagatcctgggaaggatcagagactgatcctggtgcaccctccttccatccaggctcaggggtctggaatgcagccactgtctacatgtgttggctcggggtggtgggggcaaatggacaggaaggaggcactgccctcagctctccttgagctttgggggctgcttctgccaccgcgcccaaccctcaggctgccacagcctttcaaataaacagtccctctctgtctccctccctctctgcctcctgcccgagttctcctctcaggcccgtgtcagttcgccctctcataccctccgcgagcagcgctcacttcccctctccagctaggctcgcctgctctgccttgctctcacactccctctcactcttagtcactctctgcctctttttctcaagtccttttgtttctcgcacatgcccgtgctctccctctcaggctcattttctctcttccttcccctcttcctctcctggcttttggtctctctcctcagccctgtcagaagctggcaacccccctcccaaaaaagaaaatctcccagtgcctataaaccctgcttaattgcttccttcttgggaaaaaaaaaatcaaaataaaagaagtggtggggctgggggtccgcttccaggttccaaggtgcgtgcggcccggccccagccctgactgagaggggaagcgggaatggctggcccaagactcccaagcctctttcccaaattggtgctggggccttctgggatgctagtccctgagtggcaggagcttc

SEQ ID NO: 137632 - DNA, 1085 bp, Homo sapiens
ggtcccctcaccccaccctgtttgacctttggaacagatgttcctggctgggtgcatgtgtattaggagtgggggagcaggcgtagggttacagtatccaggccattcttggcccacccttgatgactgagggcacctatgctggccgggtccctgcctctcacctgttctgtctccattcttagatcccaatgctgtgacgcctgagcagctgactaccagcaggcccagcaaggaggcagacaacactgtcaagatggccacacaggcccctggtagtcggggctccctgggtgactctgatggcaagcatggtaagtgtatgtgtttcccagaggtcaggagccattgctctgtcaccttgttaggccctgtccctgaagaaatgcaagctgggcctggcctgaaatctgctgtgtgtccctgggacccctggctgactgttccttcccctttcccttcctcagagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgcct

SEQ ID NO: 137633 - DNA, 1047 bp, Homo sapiens
tccagaccacccccacccccccaaccttgtgtcaccggctgagactgcaatccccactccctgtttcttctctctaatatagcactggtggggggagggggtggggaagcagccctgtgtgtgtgtgtgtgtgtgtgtgtgtgtgtgtgtgtgtgtgtgtatagcaggagagctggggattcccatcctagaggatggaggtggccgaggtgaggctgaagcagttgggggaaggcttagcaggcaggcgagcggctgctccagaaagagggcggctcagacagtggttagctgcggagtggggcttagcagagggaagggggaaagggagggggctctccttctcaaggggccctttcatgttgaaatcagccagcgtgaatgctggcggcccaggagcccagccgggggaaatgtgagagcccccttatctcccctcatgtcacagtgccgtctgcagttctcagccgggccagagaggatgcattaggagaagtgttggtgggggatgggggagagaatgctcccatcaagacctagggctgggcccacttagttaaggggaggttggaggaagcaggttccagactgtcctgctgctggaggtgggggtggactggagtgccctgcatctcgaagcaaggagagccagcaggctttggggcctagggtggtggatttggcaggaatcagaaagaaggcctcaggttccacccctatcaaatgccagaatgccctatacagcatgcctctggtctgctctgggagtgcagtccttgcccacacacctgcaggagcaaggagcccactccctcctgggagagctgggagagtcaggccatgggttccacccctggattcagttctcgtttctgggtaggaaacctggaacatttgactaggaaagccaaggcctcacctttcccaggacactctcagcccaggagtgacccctgctgttcaaacaacctttaaggcagaggacagagccattagcttcccatggcttggactgggtggtccttcctgccccttccaaccctgcaa

SEQ ID NO: 137634 - DNA, 1049 bp, Homo sapiens
tggccaacgagggcccgcttggcttccctcaggaagatcccggcctgagaggtttcagtcagtgttcgagcaacatttgaattgtcttttaattatttccccccaatcatctgcttgttgaagagaatttaagaaatgccctcaaaaaggaaagacacttaaaattacctatatcccaccactgagagagaaccactgttagctaacttcatggtaggtttcctgataatctttttattatgcacatatacaatgtgaagatctcttttacatacctgagatcatggtggacctgctttgagtgctgggccaccttccagcccccacatcatatcttcatgaggccagctcaactgcagttcttctctcttggagacctgctggagccaaaatttctggttccccaccgggggcctggccttgtagctgaaagtctcgactggcgttttcccatttatatcctgacaatagactccccagttcattactacattactagatgtcacgtgggagggtctttctttaactcagggtctcacatgcacaacacacacacacacacacacacacacacacacacacacacacacacacggtactgtttcatacctccaggccttcgttcattcaggcccctttgcctgagatttctgcccttttttctccctccctccctctttctctgtctctgtcatgtatgcacatggtaaaaaaaaaaaaaaaaaaaaaaagaaaagaaagaaagaaaacaaacaaaaataaaaacaatcaaattaacataacaaaaactccaaaagagaaaaagagcatacactgagaagcgaggctcctcttgtccctcaccttggcccctgtttcttatatatcatctttcctgagatattctgtatattggttagtacaaatgaaaatgtatcttttgtgaaccatgaatgataataactgcccactgttggacaccttgcttttgtaacttcttgattttttgatactgttgcacggcaataactgtggatgtgcctcatgctgggtacaggctgtctagcgaa

SEQ ID NO: 137635 - DNA, 1214 bp, Homo sapiens
catttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaa

SEQ ID NO: 137636 - DNA, 1364 bp, Homo sapiens
gtgcctttgttccgctagggacccacaggcgaggcctcttggtcatgcagatgtacctcaagtacctattcattgtcttggggaggccctgactccatatgcagatgcggtaagcagcgatgttaagcattctgtttaataatgtaaaaggccttcttcattgtgggctgggcggcatctctgcagaatctcttgtgatgttaaatgattttcagcttcctttggccaggctttgcgacagcatgggggcaggtggggaggggggtgggggggtcgatgacagccctggcatgggaatagaaaggacggaagaaaagaagctcgggtttgaggaggacagggtcccagcaacgaggcggcagcctggattaaagaccatgaccgccagcagtgagccctgggaaagggcagggactcagagcaaatgaggccgctatcgattgtaattccccatgccagtattaccccaagagaagttctgtacaggagaggattttaggtgggccatggaggaaaaagaaattgaatacttggggccgggtgcggtggctcacgcctgaaatcctagcactttgggagactgaggtgggtggatcacaaggtcaagagatccagaccatcctggccaacatggtgaaaccccgtctctactaaaaatacaaaaattagctggttgtggtggtgcacgcctgtattcccagctactcaagaggctgaggcaggagaatcgcttgaacctgggaggcggaggttgtagtgagccaagattgcgccactgcactccagcctagcaacagagagagactccgtctcaaaaaaaataaaataaaataaaataaaataaaataaaataaattgaatacttgcttaggatgaaactgaagcaaaaaggtgagggggggagttttgctagaaagaccaatattagtgtacatgctaggacaggtggaacatgaatatggcaagtggcgaaggtggttcgcaatgaactgctatgggaaacaccactccgtgttaccaacaagccatcagaaagtcagtaagttatgacttaccgactcagttgtatgttgggaaattaagacagaggctgtagtccacacagagactgcgggtctcagaaatagctacagcaacacagagagaaaggggcgatgagggcaccagaagggaacagggaaaatcccagagcactgggggctgcaggtgacaaaggacaagcaaaacaacagaatccccggagtgggagcattgtaaactcagggagggctctagccttcctccagagacccaggtgggctctgggacttgggccatttggatgttgagtgctcatgggaggctggggaacttggagatgttca

SEQ ID NO: 137637 - DNA, 1051 bp, Homo sapiens
acacagctagtaatggcagagctggaatttaaatcctggttggcctgagtccattgccctctttctaccactggttctcaaactctagatgcatcagaatcatcaagaaggctcattaaagcacagattgctaggtcctaccccagagtttctgattcagtggatctgccatggaggagccaagagcttgcatttccaataaggtgcacagcaggggaggttggggagggagtgatgctgctcatgtgtagacctacttggaaaaccactggattagagcattagctggggactgggtctcctcatagcaggtgtgacagtgtggaggcactgtgacttagcaaagtggtgcttcgtctggagttcttgagtttatgacccttttcatctattgtcagccaggccaggatgggtggcacctgagccaagcccgggcttggcaggaatgctgagaattccaaactagcaagctgctggcaggttccagctaaaatgcagacaggcaccacccttagtccctaggttagatttctttggctccttggccctcagcctccagaagggttaatgctgacccactggaacagagagacagaatgaagaactttttgtaggccaggagccaatctgaatctcactgaaaacctccaaccagacctgagagattccataagcccccaagaggttgcttgaactggagactaccatgtaaatactttcctatacattcatgcaaaggttttaaaaagattgtcttaatagttgtgccctgttggcacgtcagtttcaggctctgaattcctagagagcagggaatggatttgcagggatgaggaattaaaactcacaatgacagagaaaacggtgatgacaattatagtgttagggttgatgttggtggccacagtgtaaggagaagaggagagggaagtggtggtggtggtggggaggtggaaatgaaggtgagggaggtagatggatgtgaggttgatgaagatgtaagtggtgagtgagggtgacgaaggtagtgaactgagttgtccatacccct

SEQ ID NO: 137638 - DNA, 1046 bp, Homo sapiens
gtaagtcagaaagcccaggcccagagaggggaagagactggcccagtcatacagtgcgttagaggcagagcttggtcaaaactcagttcccctcacccttctggggggcctcctggtgtaggaaccagcacttgtttctatgcctcatatagtcctctccgctcgcaaagaatggtaaaatcttgtatggccaggtcattggcaattttctgtctcccagtgttcatggagaaaagcagcaaaggaattttcattctctcccaggctttcttattttcttttatttttatttttttctctgtgcgctctctcaagctggctcttcacttgctctgatgcctctcttcccttccattttctccctgtttaattccctctggtaactcaaaaccatctgaatggatttaaataaacctctcctcaaatagtctccttcaagggggagaggatggtaagttcagcctgaagggagagtttctctgatgagtctagtgaacgctgacagcacgcggggcgggacgggagggggaggtgcgcacagtgactgatggtggtgattgacctgggagggagctgatggtgtggcaggggtgcagggggtgctggcttggatgacaatgcagagacaatgcggaggcatgagctgaagaaaggggatgcagccggccagggctgaagtgggcgggtggggggtccatgaatagcgtctcagaggagtcagcacctggggagtcacagaacagcctcacttgagaggcccagaaggctggtctaatccacttcaactcctgctcctcccccaacacacacacacacacacacacacacacacacacacacacacacacacacacacacaccagatggaaacgggcctttcccaaggggttcaggaagcattgagcagtgaaagaccctcttaaatggcaaaagcatcacctggagagggaatatcttacctcattggcaccagttagtaacattacatatgagtttatcatttacccccaacagtgtgtattacatatctatagtccctaagcacg

SEQ ID NO: 137639 - DNA, 1040 bp, Homo sapiens
gaggacgagcactcctggtggtggggcacaccacacacttgaccttatgtgacctgaggtgactggccagagccgaggcaggtcgagcccaggggctgcctgtcttctcccaaggaagtcacctgcaggctcttctcccctgacaaaggaaggagctgggaacagggaacagcgactggtgggaaggccactgaaggttagtgcattctcatacaaaactcccagtgccttcccagcaccccatggtgacagtggggggaacactggctttctagctgctggggataggtatccagaggagaggtgaggcagctgcagaccggcccgcctagggaagagctgagtgttaagaaacttcttgaccctcggcggggttgctctggacagttaggtgggtgagggctgcaaacatttgggacttgatggtactgccctgctcgcccagcctggccaggtgacctgcctttgggaggaaagagaacagcaaggtcaaagggtcagatgacaaggagaccaggaggggtggtggcctcacacatcctcgagctggggccaagagctggagagtgagacagttgctttctagcctagctcgtgtccctccaagactttggggaggggcagaaagtgccattttccatccagcatggcccttgtggacttctgcagggcttccatgcttttagcgggttccctagggattggggcagagggttgggaaggaaaagggtagttcctcgctcctgacttcactttctccttctcctttttcctgctctcgtaacctagcagtctccctcccgcctccctcagcctcagctgactcactgcctcactcacactaccaaatgagatattccacttcttaaaggtatacagacagatagacacacacactgccatacaccatcaccaccaccccgggcaaagtcacataggcatgcagagaggtcgtcacacccacaaacagtgtcattagaagcagatgccgtgtcacacacacgcacatctccccatggtatcagagacacgcaggcaga

SEQ ID NO: 137640 - DNA, 1050 bp, Homo sapiens
taggctgaacctcagactcaggggcgggagtgtgccttagaaaaactcctttggggcagttattctgtgcccccaccctctgaggcagtttaccttctgtgtgcccatacagactgggcatcaaacctgccctccccagctcatttctcagccacatgtggattccagctgccagtgttagctgaaagccaggggtggcccctgcttctggggatctggacaaatctggacccctacaagcaccattctccgatgctggcctggtaggtctctggggaatgggtatgtttgcgttttgtgtgattacaggcacacagaccagagtgtgtgcaagaggccagggatgctggaccagccttttctccctgggcataaaagtgggctcagtaacgcctgaatttttgatactgttagccagataggtgcttagaggggagggcaagggcaccaggcgagctgcagctggctctggagagggaaggagttactatggagtgacagggactgccagggccaaagctcctgctcgaatgcattctggagaaaggagctggaacctgagccacaagtctgtgcaccagaagatgaggccaactggctgcaaagacgaaagggctaagaaaggggaaggaaagaagaaaattgcgagtctttgagtgcctaggagatgccaggggctttatatatgttcatgaactcatttaatcctggcagtcatcctagcaggcaggcactatcatgattcccattttacacatgagacaactgaggctcagtgaggtgaaatgacctacccaggccacatagcaaaaggactggcatacaaacctaggtctgtctgttctttctccagtgcacagatgcatgaagaaaatgctaataatctcctccaactgtcagaggtagtgcccagctggctactgagaggctgggctgagaagctgggccgactggaagggaggcccaacagagcctattggtagcttagaggtcctctggagtggcccagatccaaaacgaggacccaccaacatcctctttgttcaacgt

SEQ ID NO: 137641 - DNA, 1075 bp, Homo sapiens
gctgagcagatcacctgaggtcaggagttcaagaccagcctggccaacatggcgaaaccccagctctactaaaaatacaaaacttagccgggcatggcggtgcacacctgtaatcccagctactcggggtgagacaggagaatcacttgaacctgggaggtggaggttgccgtgagctgagatcgcgtcactgcactccagcctgggtgacagagtaagactctgtctcaaaaaattaaaaaaaaaaaaaactccccattcttccctccttccagcccctggtaagcattattctactttctgtctctaggaatttgagtaggtacttcatataagtggagtcatacactatttgtccttttgtgtccagcttatttcatttagcatgaacatttagtgttcaaggttcatccatgttgcagtatacatcagtacttcattcctttttatggctgagtaatagtccattgtatatctatgccacattttgtttatccattaatttgttggtgggcgtttggattatctccactttttggctattataaataatgctgctatgaacattggtgtacaggtatcctttgagtccctgctttcatttcttttgggtttatattaatacctaggagtagaattgccagatcatatggcaattctatgtttaactttttgtggaactgccatcctgttttccacaatggctgaaccattttacattatattacattttatgttatacattctgcaccattttacatacataacagcagtatgcaagaattccagtttctccacatccttgtcaacacttgttattttctgaagtgttttcgataatagccatcttgatatgtgtgactatatatttttacatagttgaaatcatactgttttttaccctgctcttttaaacttgttacactatctcttcatgtaattaaatattcataaacatcattcttgatgagtgtacaatattccatcacatgaatgtaatgtaatttatttaactagtcccctattgacatttatgttacttccaacattttgctattataaataatactgtgat

SEQ ID NO: 137642 - DNA, 1007 bp, Homo sapiens
acagagggagacatctgcatattttaacaaatgcttcagggggttctgaggcactctgaagtctgagaaccattgctgtgaggaacaacaatgaacctagaaagcacccctaaagatacaggactggatgtgggtggcaagacaggaacaggcaaggtgcatgagagccatctgggcatctgttaaaatgcagatgctgacttggcaggtcgggggtggagcctgagattctgcatctctcacaagctcctaggtgatggtgatgctgctggtccaggtccacactttgaagagcaaggacctagatcagtggatcagtggttgacaactggagacaatacccctaccccaggggaacatttgacaatggctggagacattttttttggtttttttttgttgttgtttttttttttggttttcacaagaggtgaggggagagaatgctactactgtgtaatgggtagaggccagagatgttgtgcagtatcctgcagtgtacaggacagcccccacaacaaagaattatctgacccataatgtcagtagtatcactgttaagaaaccctgggcttgatgataaccaaagagtatggagcagggaatcttccttagctaggacccagtgcctggtaggagtggactagatgagggacaggaagcatacccatgaagtgaaactgcaaagcagaggttccaaatgaaacgtagcagtgtgtttgatgtctgctccatgccagagcggaagccaatagggcagagcatggatcaagtagagctcaaaggcacatgtgttgcctggtaaggcaggttcctggttttttttttattattaaaaataacccctcacatttacattacacttcagagtttacaaaacattttcatatatgccatattatttcatccatacaacaccctaatgaggtaaagcaaggattattctttctctttcttgaatttagaaactcaataccatcagccaaagaaatgtttgctgaattgaa

SEQ ID NO: 137643 - DNA, 1679 bp, Homo sapiens
aggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccct

SEQ ID NO: 137644 - DNA, 1043 bp, Homo sapiens
ttatggtaatttgttatgcagcaatagataactaatgcacagccccaagggtaagctgccattgaacaactgggagctttgcttccaggagccacagttgggacctacacattctgacaaaagaaaccagcaacaagaggagggaggagccagtctcggagttgaaacagatgctcgtggtctttaccccccgccccccaaaaaatatatgacttttcagttcagagtcttgaactgcctccaaaccaacccagctctgctggcttcttgaccctgcagtcggctgtcacatcccaaatatgctgttcacagtcacaaatgaattgcagattgatggtactgtacacttgccctgcttctcgctgcagattttcagctatagctaattccccttgcaacctttcttaaccccacctggggatgtggccttgcacccagggccccagctgctccagcagccctaccagttcacaggcaactgcattaagacagcctgagcctcagaaactgtccgtttctccctttcttctaggcgccagaactggggccagcaggacacccaggctggctctcagtaaatgccagaaaggggacatagagtaggattgcacaattgggctgggagctttcttacgatcttggtttctgctgctttgtatcgtggtcactgtattagtctgcttgggctgccataacaaaataccaaagactgtgtagcttaaacaacagaaatttatttttttttcatggttttggaggtggagacatccaagatcaaggtgctagacaatttggttcttggtgagagctctctttctgccttatagactgccatcttctcatcacatcctcacatagtgaagggagagagagctctggtttctcttcttcttccataaaggcaccagttctctcatatcagggccccatccttatgacctcatttaatctttattacctcctcacagcccctatcaccaaatacagtcacattgggagttagagctttaacatatgaatttggcgggggcagggggaataaa

SEQ ID NO: 137645 - DNA, 1269 bp, Homo sapiens
ggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgac

SEQ ID NO: 137646 - DNA, 1115 bp, Homo sapiens
ttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatactt

SEQ ID NO: 137647 - DNA, 1036 bp, Homo sapiens
taataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccct

SEQ ID NO: 137648 - DNA, 1035 bp, Homo sapiens
cacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagc

SEQ ID NO: 137649 - DNA, 1626 bp, Homo sapiens
ctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgt

SEQ ID NO: 137650 - DNA, 1037 bp, Homo sapiens
aaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttct

SEQ ID NO: 137651 - DNA, 9092 bp, Homo sapiens
ttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactat

SEQ ID NO: 137652 - DNA, 1642 bp, Homo sapiens
atcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatg

SEQ ID NO: 137653 - DNA, 1748 bp, Homo sapiens
aggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttct

SEQ ID NO: 137654 - DNA, 1024 bp, Homo sapiens
aactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttc

SEQ ID NO: 137655 - DNA, 1052 bp, Homo sapiens
ttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaata

SEQ ID NO: 137656 - DNA, 1058 bp, Homo sapiens
gtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttccc

SEQ ID NO: 137657 - DNA, 1789 bp, Homo sapiens
aggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaag

SEQ ID NO: 137658 - DNA, 1571 bp, Homo sapiens
atcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttg

SEQ ID NO: 137659 - DNA, 1034 bp, Homo sapiens
catttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtatt

SEQ ID NO: 137660 - DNA, 1781 bp, Homo sapiens
ccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcat

SEQ ID NO: 137661 - DNA, 1030 bp, Homo sapiens
gatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaat

SEQ ID NO: 137662 - DNA, 2278 bp, Homo sapiens
ttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctc

SEQ ID NO: 137663 - DNA, 1071 bp, Homo sapiens
caagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgag

SEQ ID NO: 137664 - DNA, 1040 bp, Homo sapiens
tattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgta

SEQ ID NO: 137665 - DNA, 1021 bp, Homo sapiens
agcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatgg

SEQ ID NO: 137666 - DNA, 1049 bp, Homo sapiens
ctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatt

SEQ ID NO: 137667 - DNA, 1038 bp, Homo sapiens
aaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcaggga

SEQ ID NO: 137668 - DNA, 1042 bp, Homo sapiens
attttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattg

SEQ ID NO: 137669 - DNA, 1049 bp, Homo sapiens
ggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgag

SEQ ID NO: 137670 - DNA, 1070 bp, Homo sapiens
accattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatat

SEQ ID NO: 137671 - DNA, 1077 bp, Homo sapiens
ttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaa

SEQ ID NO: 137672 - DNA, 1047 bp, Homo sapiens
atgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttt

SEQ ID NO: 137673 - DNA, 1084 bp, Homo sapiens
atctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacc

SEQ ID NO: 137674 - DNA, 1050 bp, Homo sapiens
gaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttc

SEQ ID NO: 137675 - DNA, 1098 bp, Homo sapiens
tttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaa

SEQ ID NO: 137676 - DNA, 1038 bp, Homo sapiens
tattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaa

SEQ ID NO: 137677 - DNA, 1179 bp, Homo sapiens
ctccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagtcgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatac

SEQ ID NO: 137678 - DNA, 1082 bp, Homo sapiens
tggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaatttta

SEQ ID NO: 137679 - DNA, 1043 bp, Homo sapiens
attagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttct

SEQ ID NO: 137680 - DNA, 1026 bp, Homo sapiens
atattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagc

SEQ ID NO: 137681 - DNA, 1108 bp, Homo sapiens
ctccaacccctgaccccatcacttcttcttcttttttttttttttctgagatggactgtcactcactctgtcaccaaggctggagtgcagtggtgtgatcttggctcactgcaacctccacctcccgggttcaagtgattctcctgcctcagcctcccgagcagctgggattacaggtgtgtgccactatgcccagctaatttttgtattttttgtggagacggggtttcaccatgttggccaggctggtctcaaacttttggcctcatgtgatccgccagcctcggcctcccaaagtgctgggattacaggtgtgagtcactgcaccccacccccatcacttcttctggtagtactaaaggtcagcacagaccacctctgaggattggcccagaggggctggaaacaatcttattatgtggcagtgggagcaaaatcagtggctgctagcacagaataaacactatccatctagatatccaaacaaatctattttggcctgtctctggcctccctggacaggtggggatcatggcccactcagggccttggggtccccagcaggaccaattgggttttggtgccattgtgttcctatttacacttctgaggctactaagtcagacatggaggtggcagtcagggaagtagctaaatacagtcattaaggaaactcagcacagccagttcaggactgactgagttcttagaaactgtccccatgtagctgttttttttaaccttcctttaccgtttctgtactcacaacccctcccttccaccccaagctctgtaagcatctggcatcttggctagcttgctgcttcccaaggctcctgggggttcacgcattttaggctttgtgcactctggggactggacattattccaaagtgctgttctttcatgaatgttcatgtttctttgggggaagaaaatgaacctaatcattcagtggagtgtacatacatatcactgaagtagcacaggggagaggaaagagtcagaaagatgtagttttgaatcctggctcctaaactaacttgactaagaaatattgggaaacttaattaatctctctgaacttcactttctgtcttgtaaaaag

SEQ ID NO: 137682 - DNA, 1047 bp, Homo sapiens
ctcattttggtgaagcacattctccagtagttttctgagacaggagcatgggagaccaattatctgagacggtgtgcatctgaaattacctttattccacttctatacttgattaataatttggctgcatatataatatcttagctgtgtctagtgtaagtatttgagtctagagtctgtttggttcaattttttggggaacaatcctcccatcatccagttgtgtaggggaggagagggaacctggggttctaattccttggcagactttcaaccaatcctccagtttttctagccctgtgcctcatccctgcctcttgtggcacctgatgcctccaaattctgagtctttcctagatcctccagtgcaaataggctcacatcttgtaggcatcccccttgcaggtaactagattttaatttttttgttctaagtcagttacccactcttccatctgctttcctacatggaaatgttttgctaatatctcttatctgctgttggcatctcattaattctctttctccttgtggatctacactttaaaaaacattttaatgataattttcatggagctccagcaagaagtcaaggcaaaaccttgtgttcaatctgcaatgttcaattagaaatgttctctgtcttttctaaccttttactgacccactttcccaaataatcttactacagctgccttaaaaactgagtccagtagtaattctgagtgtggctccctatgactcatctctagtaactcttcctaaccatgctaacctacagtgttcctatcttactggaacttaatacagcccagtaccttattctattctggtttgtatttttctttgtttgccatctggtgtgctcccaactgggctgaagatgggtctttgctttccctggtattcccttaactaatgcctcagagagaagatttggagaggaggacgtgaattggaggaaaactgttccaggattccccacctctggtggcccaccgctggctcactgccattgaccacactgcaggcagagcccagtgcagt

SEQ ID NO: 137683 - DNA, 1176 bp, Homo sapiens
cagtaggggcaatgccaagtccagggttagagcacattcagcggtgtagtatctgtcatgtggctgtcaggcatggctactgcctgcattgtgtgcagacttggaaatgaagtcggctctcaatcagcgaaagactctacaggcccaactgccacacacattgcaggaaggccatatttgaatcccgccaaaaacctttgctgtggggtccaatgggctcatacttccggtctcccaacagccaatcctagcactgggcatttgcgggtggcccagcaagtggcctagcacttgcgggggcgtggccatggagacacagtgaccaaaggcagagaagaatgcgaatgggggaggggaagcggaggctgaggtgagcctagagcggcggttagagccggtgaggtgaaagagagcgaccgttaggacaggctgaggacttctggtctgttcggtacttgaactgccagcaaatttcaactcccgcttgccattcaacatcatggatgatccgaagagtgaacagcagcgcatactgcgccgccaccaacgcgagaggcaggagctgcaggcccagatccggagcttaaaaaactcggtccccaagaccgacaagacgaaaagaaagcagttgctccaagacgtggcccgcatggaggccgagatggctcagaagcaccggcaggagctggagaagttccaagacgacagtagcattgaatctgtcgtcgaagacctggccaagatgaatctggaaaaccggcctccccgctcctccaaagcccacagaaagagagaaagaatggagtccgaggagagggagcgccaggagagcatcttccaggctgagatgtcggagcacctggccggcttcaagcgcgaggaggaggagaagctcgccgccatcctgggagccaggggtctggagatgaaagcgatcccggccgacggccactgcatgtaccgcgccatccaagaccagctggtgttcagcgtgtctgtggagatgctgcgctgccgcaccgccagctacatgaagaagcacgtcgacgagttcctgcccttcttcagcaaccccgagaccagcgactccttcggctacgacgacttcatgatctactgcgacaacatcgtgcgcaccacggcatggggaggccagctggagctgagggccctgtc

SEQ ID NO: 137684 - DNA, 1056 bp, Homo sapiens
acaagtgaagtgccataagaaataggtgctgttataccgcagtttcttggtcctttttttttttttttttttttgctgctataacagaatactaccaatgggtaatttataaagaaaagatttatttggctcattgttctggaagcagggaagtccaagagcatgctgctggcacctggtaagggcctcatcccatgtaggaaagcatcacatggtgagtgtgtgcagaagacagaggaaattgggctgaactcatccttttctcaggagcccactccctcaatgactaacccacccccatgaaaacagcattcatctgttcacctcttaaatgccacatcttccaatactgttacattggccattaaatttcaacatgagctttggaaggaacattcaaaccacagcatcttgttttacagatgaggaaattgtggctcatagaggttaaagtaactggcccaatagtgttacattcagctgagatttgaacccaactctgttggatccagatctgattccagagcccatgcttttaaccaccacactctactacagaagaggggtgaattatagacctagtgaagaataaaagaaatgaaaatgtaacacatatgtgctagaaagtaaatggaagaaagattgaatcagtaggctggctcatattatggaggatgtacagtctgccaggagagtgcagacttgataagtaagagaaaggcatttatgttaattaaatatttattgaggacctttggagtgccaggcactgtgctaactgctgggatataaatatgcatagtcattgctcctgaggctctaacagctaggtgaggacagagacaaacaaacgcatgaattcaatgtaatgaagcaaatgctgttatcgtgatacctggagggtatgactgacagaaacatccaggaggagagcctagctagggacttcatagctctgttacccaggctggaatgcagtggtgtgatcctggctcactgcagctcaatcttctggggctcaagtgattctcccacctcagcctcccaagtagctgg

SEQ ID NO: 137685 - DNA, 1092 bp, Homo sapiens
tgtatttgaagaggatacaaagaagcctgccaactcagccactggcccatcttcctcaacctgctcagtgagtggcactccaggtgagggactcaagggctctaagtaacacaatataaaaagcattaatctggccaggtgcagtggctcccgcctgtaatcccaacactttgggaggctgaggtgggaggatccctttagcccaactctgctactgaatagctgtgggaccttggagaaattccttcctttgctctttccatacatgctgtgtgctacctgaatgctaggcattgagaattcgaacactacccgaggtttaagctcttaaggggtccatagttccacggaagagacaggtaaacaaataatcaaatgttaatttgataaatattttgataaaggtgtgttcaaggtgttagaggaatggagagaataactttggcccggaggggcattctgttaaaggtcaaactcaataacatgactttaagatcctttctaatctgcctgctgacatccttttcattttgttccttcgtggatcctaagctgaatctttagcaaactctcctagttctccaaacctatcatgttctcttaggccttcatgcattcacataggtggtaccttctgcctggaatgtcatcttccttgtctgtgcctggcaaatttctattcattactcataacttggctcaaagatcacttgctctgggaagcacttcctgattttcccctgtaggcgaggctacctccttcttagctcttatagcatttgattcatccccctgtgatagtactgtactgtggttatctttatccacacctgtctctcactaaactgagagctctttaaggccagggagagtgtcttactcatctttgttcactctagcacagaacctgccacccagtaggtaggagagactcaatgttaaatgaataactttgtatcataataatacctaaccttctctgagcgctcacatcctgccaagtgactatgctaagtactttacatgtgaaggagttcaggagatgccatcccaaaatatgccactttggtatgctgattatttgaaccaagg

SEQ ID NO: 137686 - DNA, 2947 bp, Homo sapiens
cgctcaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcaggtatgggggaagatagtaataatggctgagaacgaaggtaataatggttaccaagggtggagccattgcgcctgagtggaggggacctttagtggtgagaacgtttcgttcctacttaccactgcgatcttgtgtacattgtttacattccccacctctcttcccagatggttgatatcttacgactctgcttcctagcgtctgctgattgcataggcattgggtgtgagccctcagccactttcattgagtgaaactggccgctgttccccgtgcctcctccctctggtccactcccagcccagcctcccactccgtcccccagaaagcaagggccacaatttgaatgcctagtcaggcttcactgcctcctttttgctcttccagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagaggtgggtcaatagctataatatgaggcctgcccaatggcggtgcttttcaggggcatgctttcttggcgggtggtggggggccagaatggtatgtgtcactttcttggttcttattgagcataggccctagggagagcaaactttcctgagtttttccaagaagcctctgcttttgttgagatgattatacctacttatcagacccttactaccttatggttggcaacagcagcaatgtagtttagcagagtgtctcccaaccttttccacatcacatcatagcaatgttcatatggtacagtggggtagatgtctctgaaaggcaaagctaggccattttatggtccactgattgaggagctctgttcagactactggagtagatgtgtaacatcctgaactgatcttagtcctggcacagcttcattgtgtgaccttggaaaagttgcttactttcttaggttttttttgttgttgttgtttgttttttaaacaacatttaatgggtggtcatgatgtctaggaactatgctaggcactggggatacaaactgtataggtatttgtgtgagtatgagtggtccctgccttggaggagcatacaatctggtgaggaaaacgggcatagaaacagaatatcaatataaactgatgttgtggagggatgcacaaggtactatgagagcagacaggaagggcacctaaccaaagggagcaggagagaggagaaagctccctggaagaggtgactcctgtgctgagttctttaagggtaaataggaatatccaggggaagaggagaggagggcattagccggcagagtatgtaaagccttagtaaagccacagaggcattaaagaaacagtggtgggtggagatgtgtagaccaaaaacagcagctatgagcaattaggtgatggtagaacacaaagagggtggtggtaagggggaaggaatgatactgaagaatgttgtagggtccacatcaaggagagcctgggatgtgaggaacgtgaagagaaacttgttgctgagaacttggtaaggtgtttgaatcccagctcgacgactgtgattaatcactgtgatttgtggtaagttatttaatctttcagtaccttaatttccccagctgcaaaattcagataataataggttcttcctcataaagtagtttatgaggattaaaagagaaatatatataaagcagttagcccaatgtttgacacagtaaacactcaaagtcaactattattatttgtggctaagagtatgggtcatagagtcagagacctgggtttgagatccagctttacttataatctgttggactttggggaagttatttaacctaactgagcctcagctttcctcatatgtgaaatctaagtaataatggtacagatggtccccgatttgcgatggcttgtcttagaattttttaactttatattggtgcagaagcaatacacagtcaggggaacatcaataaattacatgagttattcaacactttattataaaataggccttgtgttagatgattttgcccaactgtaggctaatataagtgttctgagcatg

SEQ ID NO: 137687 - DNA, 1653 bp, Homo sapiens
ttgaggttaaggtgcctaggagataagtagaggtgtctgttagtctgaagctcagaggagaggcttggtctagagagctgaagatgattcatttattcagaaatatttattaattgcttcctgtggggctgttctaggtgttagagaaccagatgaagtcagtgctgctatggagcttttattctggtggtagagacaaacagtaagctagtaaataatgtaatttccgctggtaaggaccatgaggaataataaagttaggggatagtgagtgactgaggatatgggctagactgatacgaaatggaatttaacatcctgtcctttgtaagaagttgagggcggcctgtcagcagataataggtagtttaaacagtgagtttggtatccaaataattatacaaaaaaaaaaaaaaaaaaaaactgcaagagaaagatgagggagtggtcacatctggttggagggatgaagaaaaggtttcagaacataatggcatttgacaccaggcgcggtggcttatgcctgtaatcccaacacttcgggaggctgaggcaggtggatcccttgaggtcaggagttcaagaccagcctggtcaacatggcaaaacgccatctctgcaaaaaaaaaaaaaaaaattatccgggggtggtgatgcactcctgtaatcccaggtactcgggaggctgaggcagcagaatcgcctgagcccgggagtcggaggctgcagtgagccgagactgcgccattgcactccagcctcagtaatggaatgagactgtgtctcaaaaaaaaagaacataaatggtatttgagatgagtcttaaaggatggttaaaaatagaaattaggctgagtgcggtggctcatgcctgtaatcccaactctttgggaggccaaggcgggaggattacttgagcccaggagttcaagaccagcctaggcaacaaagtaagactctgtctgtaccaaaaaataaaaataaaaaactagccaggtatggtggcacaggcctgtagtcccagctactccagaggctgagctgagctgggaggatcacttgttgaggctgcagtgagctgtgatcgcaccattgtattccagcctaggtgacagagcgagaccctgtctcaaaaaaaaaaaaaaaaaaaagatttttctgaatgtaaaagtcatagtgctcattgtagaaagtttgcaaaacagaagaatattttttaaataaaaaataagcctcaatcctagcactcatagatgatcattgttaactttctgatgtgtttcctttcagttacatagttatttaagctaataaatttggaatgctgtaactatagctttttatcctgtttttttaacctaacattataccatgagcatttcctcgtgtcttttgaaaccatgatattgaatgttccatgctctagttgtaccataattatttaatctgttattgtcaaatatttagacactggttttttgctattctgagtaatgccataaacaaacatctttaaatgtatctgtcactgtttccttagggtagatttctagagccggtgactgggtcaaagtgtttgaatattttgaggctcttgatatgtggtaaaagtgttgctttctacaataacagagtttcagaatatgttccact

SEQ ID NO: 137688 - DNA, 1219 bp, Homo sapiens
cccacattcgtattactagcccagacccctcctgaccttcagacccatacttgcaacacccttccttcatgggtgtttcacagacatgtcataccttgaacccttggctttttaacccccaaatgtgcctcctcacccatctcagtaagtgtaccaccattgacttaggtttttaaaccagaaacctaggatttagcttcaattcctcactttttctgaattttcacatccagtccatcagcaaaggcctttccattccagctacaaaaggtatcttctatccttctatttctctccatctccactatcatacctcagtctaggctaccagcatttctcagctgagatagacaaatcagctccaaggccttgtgtgatctgctgcctgcctcttttcagtctcaccatgtatcattctcccctcgttcactagacttcagccacaatgaccgtctttcagttctttgaatagacccagctctgtccctctatagaatgtctgtgtgtgcagttctctttgcatggaatgctcgtcatatggctaattcttcatcctctaggtctcagcttaaatgtcactcctcaggcctttccagatcagtctctttaagtagttaacaactattattctctctttgcttcatgtttgtttccttcttggcacttgtgtgcagtcatttcatgtgtctttctgagttttgtctctctcccctactacagtatatactctatgagggcacaagccatttcttgttcactatgttatgcctgccatagagcttggcatatagaagttcctcaagcaatgcttattattgacaagcaggagaaacaagatgaacaaaagcccaaagccagggtatatttaggtatgttcaaagactacataatagtctggtttggcagaagctaagaggagtatggttgcagctctgcatgaagaagtgatgtgtatataaaatactgaaaaagaagagaggcagagggagaaatacaagttagcatgttataatagtactttaaataggaagaagtgataaaaaatgaagttatagctatcagagatactacttttgcaagaatagtttacatggttagaaaacaaattactcagatccttatttactttccagaagtcccccaacccatgcctttagatactgaggccatcttacataaaacagctgaatggtatgtcctctgtctcaaaacctgtttc

SEQ ID NO: 137689 - DNA, 1002 bp, Homo sapiens
tcttcaaattcccagttctagtatcattcccactgtagcacagaaaagagaagagtaggccaggtgtggtggctcattcctgcaatcccagcactttgggaggacaaggcgggcagattgtttgagtctagaagttcgagaccagcctgggcaatatggtgaaaccctgtctctacaagaaatacaaaaattagctgggtggtggtgcacacctgtagtcccagccactcaggaggctgaggttggaggatggcttgagtctgagaggttgaggctgcagtgagctgtgatcacaccactgtactcaagcctgggtgacagagtagagaccctgtctcaaaaataaagagaagagtgatcatttgaaagggtagaaaaatgagttgagggaaagtgtttctaagacaggggaaaggcaccagtagagtgaaaaactagctgctaatgaccaggaggatgatcaataaatagagtgaggcccggaagaatgtgtggggggtactagattgataacaaaagtggagtggtaaagacattacctttggttgggcacagtggcttgtgcctttaatcgcagcactttgggaggctgaggcaggagggtcatttgaggcaggagttcaagatcagcctgggcaacgtagtgagacccccgtctctacaaaaaaattaaaaattagctgggcatggtgatgtgtgcctgtagtcttagctactcgggaggctgaggtgagaggatcacttgagcccaggagctagaggccaaagtgagctgtcatcacaccactgcactccagcctgcgcaacgaagtgagaccaaaacaaaaaaaacacaaagatattaccttggaaatggcttggtagagacagaatcagctccttaaagacaacagtaaaagaggaagagtgaagttatcgagttgttttttttttttttttttttttgtgagacagagtttcactcttgttgcccaggctggagtgccgtggcgcgacctcggc

SEQ ID NO: 137690 - DNA, 2630 bp, Homo sapiens
ttttttttttttttttttttgagatggagtctcactctgttgccaggctggaatgcagtggcacgatctcggctcactgcaacctctcactccctggttcaagcgattttcctgcctcagcctcctgagtagctggaattacaggcgcctgccaccacatccagctaatttttgtatttttagtagagatggggtttcaccatgttggccagggtggtcttgatctcctgacctcatgatgcacccacctcagcctcccaaagtcctgggattacagggctgagccactgtgcccggccggttcttgacttttcatgggtcatggaccccttgcccctttgacaatttgataaaatctataaaaatttctcagccaaaaaaaaaaagaagaaagaaaaagaaagcatacaggtagagttctgtataaaatttgtgggagttcaaggaccacccccaccacactgaactctctgtggacttcagcttaagaccccctgatttgggtgaagacctactgaggaacatctgattctggagagtctaaagtgggatttcaagcagagatatttcaagatacgtctcttggaaatcttgatgtttttccttgacttctctctttccttcaggctcttacatccaataaatcaacaaatcctatctattttatattttaaatatacccacatcccactatctccatcactaccttcctatttcaggtcaccatctctcacttggattgtggcagtatcctcttagttgctttccctgcttatatccttgcctcatagcccccacagcccatactccacacaacagccagagtggcccatatttttaaaagtgtttttatgtcactctattcatgtcatgtattcaaaagcctccagtggctttcccattcaaaataccatgatatttgatatttggttattgtgacctaccaggttctacacattatggccctggctatgtctgacctcattttctatcactcttttttatctcagccatactggccaccttgttatttctcagccatgtcaggccaggcacgctcccacctcacagccctcgtatttgcttttattccttagcatactcttctagatattggcttagttattttcctgaagtctttgttcactgtcatctcttcagagagttctcttctgactaccttgtatataatagcaccgctacttttccaccatcactgtatgcatttgaccttactttttgctctttcatagcacttatcacgacctaactcatctatttctttttgtctactcccactggaatgaatgcttcatgagaccaaggacttttatatgctgctgtgtctccagcactgagaatggtgcctgtcacacaataggtactcagtagacatttgtcagatgacatactagaatgcatcctgaaaaagaaaggcagccagggtggttatgagtcttcagatgataaaaggatgagccagaagagctgcgaaagttttgcccagaagaaaaaaagagttgatcattttttaggctgtttcacaaggcattcctgcatcagtggcaggtaaatgacccctaagattctatgatttttttgaaggtgtagttcccaaaatggaagcatcacaggaagcactgtgttgcgatactaagcacccaccctagtaaaggccagtataatcaaatgactaaggtactcatcttccctaaaggacttgctgagatccggttacttctgtatttttctggcttcagaaggtactcctcagcccctgctgggccctaacttgtcatctgagggaactgcctggtggctaattctggggtatagaatctatatccctgccaaggtggaaattggtatgcttactaccctatcatttgcaaaggtaaaatcttattgaggccttcttttgaaggaatacctcttcatttgtaagttcatgggtaatgcttttctgtggaacagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggtaagcctggccagagaaatctactgccagagatttgagtattctacaggagatcaaattaagatccttttaagtctccataaaatcactgtttttatcaagatgagtatagaaaggccgaagggtcactaaggtagctttctctttaatttaatgtgttccccagtgctttttaatctgtaacacacttgtagtcatttgtaattttgtggtataccatgggggacagaaatgtctctgaaataaaaattggttttggttgtggaaagctgtggctgctgagggaaggcatagggagttaaacctttaaaatctgtgctaactggccaccacggtggctcatgcctgtaatcccagcactttggaatgccgaggcgggtagatcacttgaggcccggagtttgagaccagcctggccaacatggcgaaaccccctctactaaaaatagccgggtgtggt

SEQ ID NO: 137691 - DNA, 1027 bp, Homo sapiens
aagggcatttccatgcacagaatgtccagtaaactggtaaagaaacctggtgtaacagctttggctatctttgaacatcataaccctgttttggagctgctgcttcaaaagaataggctctgctgccacttgttctttggttcaggacacaacatgaattgggttgaatttatcagcaagtcacaggcatttatttaagtcctcagagaaacctcttcctaatttgatttgtactaattagcccaggagctcttgcctcaggataacatcaacctagttcttcatgttaagagatcaaagaatgaacaattaatattctaaggttataaggccccttgagcatgtctagatgagtgcttttcaagcattttgaggctggacttttctgggtcctgccctgtccctttctttgtgtgtgagttttttgttttttcttgttcatttgtttgtttgttgtaatcgttgtgttgttgttgttttaatgtgctttcatgtggtattggaattggttctgaaagtgatcgagctagaactaagtgagcaccttttctttaaccatcctttgtttcagcatgcccctagaaagccaaggttccttgaaacttttctatatacgtctatatggaaactactaaccaatccttctccctttcctttgggaacattgacttctaaagcaccgtagaagttcttgacaattaagtgcataagtacattggaagaggttttagaagggtcgtagtgattcaactttttaactgaaggccaggctgaagaaaggggcttcaagttcagctcaagggatttagatggaacatggaagagggctttggaatctccttctttggacagggtattttaaagccgagtaattttttacttctagtgacatgattcctgggagaactttctctttctttcttttttgcaaggtactcaggccccctcaggagagctaaggaatctctaccgttagtgttctgctgctatatcttagagactgataaatagaaagtgagtgaatttt

SEQ ID NO: 137692 - DNA, 1104 bp, Homo sapiens
ggagaattgtatactttaaagtttttttttattattacattattggcactcttcctgccttcagctacgattctcaaaaggacatatttgcctccctatgatttaattctgagttcttgagatatgtttccctagggtggcgggagtctccttgttttctgtacctttcagagtcaccaactataaatacccattccacggtgtcttcactgctttgtggagcattgccctctgggattgcttaatgggagatgatcctgggctatttatcttctcatgaaagctcttgactttaatgcccctttctggatgcccctttttacatatcctcccatgagtttgtacaactcctcagaagttgactgggtagggaacaaggctgaaacggacacagactttgttgttagagagactttttgtagtactgggttttttttgttatttttgtttttttgtttttttgttttctaaatgcagcgtaatttttgcagagtatttggagctggttatccaagtctgccaactatgacggtgagtgactggtatgagcaacatcggaaatatggagcattaccggatcagggaatagccaaggcagcaccaggtatgacggggtaggagggaaatagttgtaccactggtcttttactccctggcaattaagttcttaccaagtatagttgccctttaggaacagaaatagtggggacaaagattctgagtaatagaaagattctagacagtactatgtttattattaaatagcaaatggttatgggaggatggggtcagtgatagcatagtttgtaaatctctccaaatgtcatgacataaaaacagagcagctgtgtagaaaactcaatctatggatagcagttccgcatctggtaatggcagagtaggttgtatcaggccagcccctcatacaggataacaattacaaactgaacaaaatattttaaaaaccaactacctgaaggtactggcaagtcaccaaaagcaggtgtaagctgaagggcagtcaacacttagaaggaggaaatgatacttggaattcattgagggcagggactttgacttactgtacctttagtgcccaacttg

SEQ ID NO: 137693 - DNA, 1019 bp, Homo sapiens
aagaaagcccaaagtaaatagatgaaaggaaataaaggcagggaaactaggggtggtcatggttctggtagtaatgcacaaaaattggacacgtgtatactcccatgacctggcagtttcactactcggtatatacctaagaggagtgagaccatatgtccacaaaagacctgtacaagattgaacatagcagcattatttgtaatagtccacactgaatacacaccactcaaatgcccataaataatagaatgaagaataaattttggtatattcacacaatggaaaactatgtagcaataaggttaaactatagtttgtttgctataagtgacaaatatagctgaatcgtgtgaaaaaagccagacgcaaaagagtatatactgtatgattccattcatacaaacttcaacaaacaggtgatacttgtgtgtgctggttgaaagctagtaagtgttcacccttagttggggatcatgaatggaactggacctacagggtcttctgaggagttagaaatattttgtatcttcatctgggtactgattacatggatgtgttcaatatgtgagaggtcactgagctatacaaatgttagtatacttttctacacgtatgttgcacttcagtgaatgtgaaaaaacccatggacaatatttataatgaaaataggtggcagtgtatccccatgaacctcacaataaaaacaggtaagggcaaattacccatagccacaagatccagcagttattggcatctgtgcaggagaaaaccagagttgacaggccatctgaaaaacttgacaaacagaattccaaaacagtgtattccctagaaagaatggcagtccaatttaagaactgcagttgaaactgggagggatgagtatgagggtccaatagtcagaaggtctgaaagcgatagagtagtctagtccttagtgaactcttgaagttgatccaccggtctcccttccaggacagggactcacactgaggagaaattgctgagagtagaat

SEQ ID NO: 137694 - DNA, 1027 bp, Homo sapiens
tttgctccccaggaaggtgggacacctcagtggctcagaccccggagggctggtccagatccagggaggtgggggtgctattgccgtttggcccagagagcagtgtgtacagattagccaaggctgtgtttccctggggggtccagggacctggtgccatgcaggctaaggcaccagggtcccagctgcccccctgggccaaagctccagttccctggggctgagacactgcaccaaagaggcacaactgctgcccggcaccaggcccagcttctccatggggcctaagctcctggtcctggagggctcgagcgccacggtcacttgataggaaaaatcacaccatgttcctgggaaaggacccagaatgaccaacaagacatagtctaataaaatttccgaactttaaagaaaaaaaagccacagacatctcagtaaaaatagtaagtgatttataaaggaaagcaacttaggttaccctcagattttttgagatctatactttatgccagaagaaagaagaaaatggaatagcaggtatttaagaaactcagagggaaaaaaatgtgagccaaggaacattatacctggtaaaactgactttcaagtataaagagtacagatatttatcaacatgcaggaattcaagaaatattgttccaccatcccatgaatttgctagagaatgagcttcagacagccaaagtgttgagagacattgaaataaggacaggtagcaagcgttaaatgtacagttacttgtagaattaagatgaaatgaggattaaaagggagatagagtatgtaatgcctatgtgcccagataatgtagataactttttaaaaatggagaaatggggaaatcatgcaaaattttaacagttctcagtaattatattggtggagtgtcaaagttagtgttattattccaagactatgtataatgtgagataatataaatgagcagttattagataatctaattctatcatcctctgtctttgagaactaggacttttaatgtgaa

SEQ ID NO: 137695 - DNA, 1777 bp, Homo sapiens
gattttcaattttatgcacaaaaacttatgtatgactatagtaaaggaaatggatggaggaggaaacgtcaactgcaatcccacccccctggcaactcacaaatcacaaattcataaatattttttctttcctgtttttggattgcaggggttgtttgatggtggtggtaatgtttttgtttaggggcttggggggggtgggtgttggccatttttgcaagaattctcttccaaaatagaattcattctgaggggcaccttttatgatttttgccttcttgtggaaaccacttagagcatcctttcgtactattttttaacatgcgatatattaggtaatgcaagttctctccccgcttccgccgggctcagggtaggcagctggctgtattcctgttctcattgcatgtggttgtgctcagagtggaactgaggcccctgacgttacttattaacattccctcaatttctcacctccctttctaatttttccactttagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaatatggctatcagctgctttttttttgccgggggagtggggacatttagctgtgggtctctgggcttatggggagatgccctttgatgtgggcagtgaattggtccagcatcagatctgcccaggcattctccttcctactgggcatatgatatgaagccatataagtagcaccctgcaccatgaagcaatccagcactctacaaggggagatcataaaaaccagagctttccctggtacacagcactattctcagaaactatagctgtaaggtgaatggaccgcaaagggatgtagtctacttcccagtcctatctacctcgtcctagcttggccagaagaaatgagagatagaggaggcactcttaaaagtcatccttgtgtatgtatctgaggccagagcctttactctcatgcgtttaccatatatcccttagggtgaagagtagcctcaggccatagccttttttttttttttttttttttttttgagacgagtgtcattctgttgctggaatgcaatggcgtgatctcagcttactacaacttccacctccctggttcaagcaattatcctgcctcagcctcacaagtagctgggattacaggcgcccgtcaccacacccagctaatttttgtatttttagtagagacggggttttaccatgttggtcaggctggtctcgaactcctgacctcgtgagccacccacctcggcctcgaaagtgctgggattacaggcgtgagtcaccgcacccagccatcctaactcttcaattggccctt

SEQ ID NO: 137696 - DNA, 1637 bp, Homo sapiens
tataggcaaaagcactttgaacagttataagacacgacacaagagtgacgagtaagagcagcaggctgttggtaagctggagggacggaggaggggatgctttttttttttaattttggtaatagagaaggggtctccctgtgttgcccaggctggtgtcaaactcctgggttcaagcgatcctcctgcctcagtctctcaagtagctgagattacaggtgtgaaccaccataccctgctgatttttgtattttttgtagagatggggtttcaccatgttgcccaggctggtctcgaactcttgggctcaagtgatcctcctgcttggcctcccaaagtgctgggattacaggcatgagccaccgtgcccggccttttttttttttttaaattcagcagttcacgacttaaacccttgctcctccgatgctttctcaatcagtcttctagatctcaccaccagccaagaggtttgtgacatgcttttcttcatgtgctgaaatgaccagcaaaaaaaaagaactatgcacagtgaaaactgggaaccagtttttacatatctgcctgccaggccacctttgacaaatgtatgtgaaaagatgatgggcaaagtcttagatttcagtgtcttgttccaactggcaacaaatccctcaaagagagtagaagtgagcaatgtcttaggctggcctagtccagtgtggtagcaggaataaaaattatggctactgtgtattaagcacctactatatactaggagctttacatacagtatttctaatcctcacaacacccaagggagatactattatagtctcagtctgtcgatgaggaaattgaggtttagagaagagatttcccaaagatcactaagctctaagtggttgagctgggcctggattccaggttggcctgaggacatatgaaggtaggaaatacatcctggtggtacactgctctggggataaccccttccctttctctgtccaagttttgagcaaaaattcctgctggccccttcagggacagtctgagacctgctcactaggggcaaaccccactcagaaatctacccctcctggggccctcgcatcactcaacccgcagtggaacatttctgcccccaatgccaagcccacctactttccctttccctgtccagccttacttagctggtctttgttcaagtaaatcttttatttttatttttattttttttagagacagaatcttgctctctttcttaggctggagtgcaatggtgcaatcacagctcactgtaaccgcgaactctgctctctttaacctgaatgccatcaactcatttttaaaaatagagacagccttactatgttgcgcaggctggagtgcagtggctattcacaggcacaatctttgcacactgcagccttgaactcctgggctcaagcgatcctcctgcttcagcctactggtagctaggataatagatacatgtccacacccagctattttttctatgttttactttgtagagatggggtcttgctatgttgcctaggcttcaggtaaaccttttaaatattttctcccagatgctcattcaggggttcctacatgttttctaagccagtcacagcatctcttcatctaccagg

SEQ ID NO: 137697 - DNA, 1365 bp, Homo sapiens
gtgtccctgcctgaggatagcagctgcaggtgggcggccaccccccaggacagtagctgctctactcctagggcagatagattgtaacacgggaagccgggaagtgagagaaaaggggatgagtgcagggcagaggtgagggaacccaatagtgatacctggtaaggtgcttcttcctcttttccaggctctggagagaagccctcaccctgagggttgcagggaggcagggatatcatgggtgacctcatctctcataaccccttcagttgccgactctttttagccaatgccaatcttctactcctttctcgttgtttctgttccttcctggggccattggtcctacaatcttcctgaaaatcttccccagtcctctttccctgtcccatttcccccacagcctcctatagcatgtgtttctctacccagaccagagcattcagctgaaggggtggatcaggcagagtcatctcaggattggcctgacgtatctgatggtgataaccagaatcaggaagtggaggcaacttccatatcacagatgccgaggatgtgccatatgtagcacccacactgacttcctggttctctctcaaagacagcatagtcttgcttaccaagatgctggaatagggtgtgatcccagggagcctgcatgccagggtccccgcatgtagctgggggcctgacactgttgaactggtgtgcagcatgaattaaagtcctgtgatagggtggggaccttagctgataacagcctttgggacaggaatgggactggaccttctttatgatgtttgctgagaacatgtatatgacagctctcctgtacttaacaaaaggacaagtggatggctcagactgagggggtggagctctcacgtctatggctgtaagttctagcattgaggagtagagcagatttgtgcagaggaaggtggtgacaagaattgacgcccagagctagtgtttcactgatctctccactttctctaggtcctgccccaaataaatgataaatctgtcaccagctctttcagatcaggcttcaggactttgaggccagggtggagcactaggactgggaaggttctttttaaagtttcccacccattcattgcttctctcttccagtgccatcttagcacttacaggcttattggatcaagttgcagaggggaggggggtgcattggaaattgagaagctaacccctaagccttgggaagtaagaatttcttggcaggcattcttgagaagggtgggctcacacttacaggccttctccctctgaaatcaccttccagcctgttggtctcctgagtcagaccccagccttgcctttctttttttcccacccttg

SEQ ID NO: 137698 - DNA, 1030 bp, Homo sapiens
tgcacccagatgcgcttctgtcagctctccctagtgcttcaaccactgctctccctgctctactttttttgctccagctcagggatgggggtgggcagggaaatcctgccaccctcacttctccccttcccatctccaggggggccatggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttctttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagcccttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctataaagtgactcggcccctggc

SEQ ID NO: 137699 - DNA, 1123 bp, Homo sapiens
ttcctcagaggatggctatggctatggctcagagggctgggcagggccttccctaactcctgcccctcactgagggccctggacagctgtcccatattctctttgcacagttcacagtgtcagcccctgccattcctagccaatatgcatctcagggcctggttgtttagttactataactctctccttctcaggggctttcagatagtgcaagaagcccagattctgcaggtaccacagtgggataggaactgatgctggacatacaggaaagatttgtatacatgccaaggttggtgtctgcgaggaaggcgaaaagtcagaatgaatctacttttcatgccagacatggcaatattcaatggcaggaaaggaaggcctctcttcttgtatgcttattttcatcattcaggaaacctttcccagatctctagaatgattagtggtcagcctgtttttgtctttagacccacactcgaggctcctacctcccttttaggtactcaatcccgcttatcttctctttctactcagatccatgggcctctcggtaggaaaagagtagatctgctaggtctttaattcattattatgatggaatgtaaatcattactcttttccagaagtttgtgcatttcttgactgaggtaaaattcacaaatcttaactgcagctcaatgaatttttacctactgtggcaagctgaattatgcccccaaagatgtcaggtcttaatcctgggaaccgatgaacattaccttatatgaaaaagagactttgcagatgtgaataaattaaggatgttgaaatagggagatcattctggattatccaggtgggccctaatgtaatcaccagtctctttatgagagaggggcagagagagttttgactctgagataggaggaaatatgaggcctgaagcaagatgttaggctgctggctttgaagacggaggaaggggccatgagctaaggaatgcaaggaatacagctctagaaactggaaaagacaaagaaatcgattctcccctaaagtctctcatggctgcaagatggctgttcctgctcaggcatggccctgctgaaaccttgattttggtccattgaaactgattttggac

SEQ ID NO: 137700 - DNA, 1023 bp, Homo sapiens
aaaaaatgatttaggttttagaaatatagaatacttgggaaccttaaataagttggttaatttatgagtctatcccaaagttcctctgatacttaaaaccgatttgattgcttatttacactgcttaatctgagagatttaggctactttattctccaatatctaacagttacatctgaactagtattcatcaacccattcagagcctttttcaaatcaaacccaattttcagtctagttggatcacagtggggttaatccatagtgagaattaaaaggaaaaaaagcagcaaaaaaaaaaaatcagcataatcttgatctgtaatactgctgccagagtaatgtttcttagtgttacttcctatggttgttgttttgtttctttgtttgggatttttttttcttgaataaaaggtcagccagtttccctacacaaaaaaaggagatggaaagacgtataccagaggttacaaaatgacagcctgaaagtcacatctagccaacagaaaaaaaaaaaaagtttataatctatccaggcttctaaagtcttttagtgagttgctgacatttgaaaatcaggaaatttgccttaaaatatggatttctgacttactggatcattctataggcagtctaagatccagatcaatagccaagcaggggcaccaccagtaataatagagaaaatctgaaattctgaaagaagctattttaatttcagcacaagtgtaagttttgtgtaattttgaaaaataaaatttaatttatgctttagatatttactttgaatattatttgggtaagggggcaccataatcttttcacactttgggcctctaaaagtcttattttgagcttcgtttacagctcctcattaacaattagaaaatttggccacactgggctggaattcccagttgtcagcctccaccagagaaggcattcgcagttcctgccactttctggttttgttgtactctggtgcaatccactcatcgggttacctgtctgaaacatacaaag

SEQ ID NO: 137701 - DNA, 1048 bp, Homo sapiens
tctggtcctagccccagcaccagctcacgtgaattcctgaatgaacacagtcttggtgtacttgtctagtgaatacaggacaacatctgtgatctggtcaactgaacaagccaggaaaagcacatgattataatcagtcagtcatccttgagaccccagctcagtgtccttagatgtgaccttatacataggcacactatacatgatgcagtgagacatgctcattgacaaaacaagatatgcattttgacaagcccatgttagagggaaagcctagatgaatgcagacaggtaagtgagatagaattttgggaaaagacctgtggctttgggaccaggtgcacagggatgggaaaagaaactcacctgaaatcttgatttttttgatgaccttgttggtgcagttgttgatagaaacattgacagagatgggttctccgtggtagtgaacctaaagcaggagcggggacccatgtcaaggctggaggacgaatacgcagatggagacctagaacccctgcttccttagcgctattgccaccctggctcccatctctgcctgcccaagtaggaaatcagtgaagaaagggcatcagaggggttctggggtgggaggcaaaaagtgggggtcacaaacctccctgtccatccaggcctggagttgtaggggctgagctgacagaaggaagcggcggatggtctgggctgaggggccagggcctgcctccggtggtgcaaattgtactttccggacaaccagccgcacatagtctctgagcagagaccaagagattagccagagcgtcctcctttcagacccacagacctctcccatgccacccccatagtccaattgttgcttaagaatgggagcaggggaaggcctccctcagagaactcctctagtcccttaatgtaagcatgtagaccaaaggttattaaactatggcccactggccaaatctggcctgatgcctgttttcctatggcccacaagctgagaatggttatattacatttgtaaatggttgaaataaatcaaagaaca

SEQ ID NO: 137702 - DNA, 2497 bp, Homo sapiens
atcgcttcaggtaggttgcagccaaaatggcttccaacgctcagcctgagccgccggacttcacgccatgctctactgacgtcggctgacggccattggcttcacacccaggcctgggcatggccacgccccctcggccccctcctggcagcttgcactgcgcctggtgttcagcgcaatcctatgaccactcgagtggggtcatggggtggagagagggatggccactgaccgtgtcagagggaagttggggtcagcgtatggggaaaagcacgggctaagtgtagtgtaatcacagcaaaggggtggaggtggggaagattgttctcagtagttccgtgaccctccaggaagaggaaataggcaagagatcgctaggcacatctgaacaaactgatttattagagtgttacagtgggggctcccacacagacgggcaccagagcgaggtgctcagctcccctcatctccctcagcctccacagccttctggctctcctcctcgcctttccgcgtaaactcctcgatgactatgtcctcagagcttgcagaagcagcagaagagaatggaaggttaggaacccctttctgggtgtcctccgtgtccactcttttttcctgatcccagaaaagtgatcccctccctgcttcccaggtaggctcctcggccccctcttggtgtccccacttttccatcagccactctggcttgtttcctttcattcccgcccaaatttcccagcacaaaagtcccccaggagcactgaaagggacataaggatgagggatgggaaggagggaaggtatcaaagaatgaaagacgaaagaagtaagggcgagcgggtgggggaaaaggaaaaagaaaaatgggaaggggatgagggggaaggatgattccaacaagagcagaaggtggagggcggggggatgcagaaagggaaaggagggcatatgaaaagcaccgaactgtgacacgaagctaagccatatgtttccactgcacatgtattgaaagcaccccaaggaagcattttcacatttctatcgtcataacatggagggtggaaatgggaagaggggaatggggcttcccaatcttgtattccattacctagcggcctctgtagcaagcatggagacggagggaaaaaatggagctgaagctgattagaggctcttcggttccctgaagaagtatctttacttcccccccccccaacttcccaatcctttgctccagcacacacgacacacacacttcccctgaatacctagacacccagcctacctattgctattccatccccaggcaaactgctagtctccaattcatgagatcagaatggtttggaccccagccctcaggacagccgtccctgtgagttccacctggtcactcaccatgagatggcttcggatggatcaggaccaagggtagctccacaccaacatcgctgcaaggatcccaaggtggagttacatctcctctctctacaagcccaatccctgaacctccctcccttagttttccagtctttggatgccctcagaccctccagaatcaatcattattttgctctccttatccccttgtcctcctcttcttgcccaagttcccccaccccacagtctctcacctggctgtcaggtctcctaggatgctgtgggtagaatgacacccaaaattagcagcgggaaatagagaaggggcaacctagtttcacaaggggatgagggatcataagacctaatgagccagccacagaatgggtttctggaagggaaagtgacttgctcactgagctcacaggtttgggaacctggtctgggagaaagggtggggaatggtttgattgggtcaatctaactgggagaaaaacagaggcgaaaagcccttgactcttcagcccctgcccagacagacccagaaccctcacttacccaccacaggacaccatcaggttgactctgactttgtaggacaccaggatccccagcagctctttgtccattcccggtctaatactggaggttgtagtattcgttttagggtgtttggggcatgaagagtaattcattctgtccccagtttcttctcatgcattcctatcaccacaccctattatgtttagtcttatcccagaatatctcccaggctctaacctttcctacccgttgagaccacatttctcttcctgacattcacttttaccatgtcactctctgctcaagagcctaccttttgaatataacaactactctgcctgactttcaagacccctaacaaccttgccctatctagcctctctaaccttttctcccctaactcctgggatacaacctaagcagacccatcttctctccgtgatcagaacatgccatgtggattcccaccttctagcctttgcccatgctgtgtccctagtctacagtgctcctttttttcctctgttggtatccagatccttcacattcttcaagatctagctcattctac

SEQ ID NO: 137703 - DNA, 1082 bp, Homo sapiens
tacagtaagtgccactttcttttttcactttcctgacagggccctaagtaagaactctttaaatactgatgactagaggccctacaagttggggatagggaatcaggagctcaagcgtgaagataacctgctctgttcctccttttcttcttctttccttcagattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaatattggtgtgacttttgaatgttaccgattggatgtaaaatgctatcgagggaagaaaaagctcttccaaagagaggagccactggaaggaacagagcaatactataccttcctcgcaactacctgtgatgtctgaccagaacattagcaaggccaaggaactttaaccacagtataactaagaaatggcatagagtgaggggcactgaaagaaactgcccgttcccctaggagctttgagcatttctctgcaggggacagtagtaatataattctctcttctcctttcccacattctttgatctggaacataaactaaggaaggggcttagatgcatttcttttctgaggcagcagtaagaaattggttcacagtttccaacttgtaagttgagta

SEQ ID NO: 137704 - DNA, 1337 bp, Homo sapiens
ttctgtaatttaaaattgcttaaggtaggaagacagaattttcaagctccaatggcttttgacagtggcttggccaccttcatttagtcagtcatatcttttaagtgtttgatttcttagcttctaagggctatcactacggggacacattttagggttgggttttgttttgtttttgtttgttttttgcttattttgagtagtgcaaggtcatggtacccacagaacttttctttgtgtctgccattcttaagagactgtattaagagagcaatctcagttttattacaaataattgctgaaggaaatggagtatattgattagatgaaaatgtttaaacaccactatgcatgtgacgtctattttgtcaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagaggtaagcaatttatgtttaattattctgaattcgaaattgtctttgggtcgaaaaataaatccaaatcaggtttttcctgacatgactcaaattagtaagttgcattttaattaattgatagagaaaacttactgactcagttggatccggctcccacccagttctttccttggtgttagaatagtctgtttaatttgattgttggaggaattgacattgccatataaaaggtgataggaattctttaattccagtttggcctctgttactgattacctgtatagtctgcagaagagtgtttgatttccctttactgtttaagacttaaatgataatgctgttgcctcatgaagaatgttaaaaaccagctgaaatattgagctgtataagcggtgatagagtgtgtttattaaacagatatttactgagaacctaccatgtgccaggcccaattctaggcacttgggtatatgaggtacttggtatatatcagtgaacaaaacaaaaattctagcccttatgggagtttgtgttctagtgtatattagtatagttgtagactggccaattgtatctaacttcataacatcaaaaacacatctttagggaactgatggcttctgggaagctagctacttgattccatagcagtgatgtcttatcctttagggggtaataattaaacttatataatttaagcatgtgaacacttaatcctgaagttcaatctcagcatgctaacaggtaaagagatgtagaactggaagacagggg

SEQ ID NO: 137705 - DNA, 1512 bp, Homo sapiens
ggtgtgtttgtctctcatttgatgttattaaaaaaatttggcaattataatactaaagttcacatcccttttatctgccactgtggttttaaatgactactatcatctcagtcaggttttctgtggtcctaagtccctttgttaatctaaaatttctaggtgggagctcttgtggggaagcaaggaaagacgcatgttcagttttatcaccttcctgttacctagaggaatgccaatatcaattaaatattatttacagagttctaaggctgagcagtccagtatgttagccactagccacaagtggctatttaaatttaaatgaattaaaattgaataaaattttaaaaattcatttcctcaggcacactagccacgtatgaagtgctcgatagctacatatggctagtggtaaccatgtttgagagcacagatagatacagaacatatccatgtattttcttctgggtcattgttagccagctactaatgcatggatatgattgaacatatctatatccaatagaaaattctgttggacagcactgtaatagacattttgctgggctttgggatgatatttttaaaattgaaaagttaaactatatataatttttaaaacatgtaagtatcataggaagaagagatagcttatttgagaatcttctgtcagatggtatagatgcaagatgaggagctagaactgaacagaaaatgtgaggcaaaattgagagtttcctatgtgggagtgagccaaatccagaagccagtgttgaaaacaggcagagcttgagtattcaggagtgggaaaatcagaggctggaggtagatgaggctaggtagtactctggaaaacttggaataatatcttactcctgttctccttcccttcttctcttgcacaaagaaaaacagagaaagttgaagatttggggtaccagtgagggacaggtgcctgtgctcctgatttttttttctgggtcattaagttgttagccagctactaatgcaaagtttaaaggatcagccctgataagcttggaatatgcaaagatgatttggatagtgaggataagaaacctggacaaaatacatgctattgtactgagccagcacttgaccctgtttcaagatcttttatataccccatgttaaggcaggaattaagtcctaagagttgtttgaggtgagatttgcaatacagagaagtatgagttcctgacacaaattggtaaggaagagtttgtaaacactcttcagatgggatggataggctttaagtaagtagagaaaataaggatattcttatggtaaggaatagctttagcaggaaagcagaaaatatacacctgagggtaataagactacacaagtctgtctggattagaggatttgggctgggaagtaacaggagatatgttaggaccagattatgaagccgggctaaagagcttagtttctatccctgtgaaccatataaactatgtaaaacttctgagtgagggattactg

SEQ ID NO: 137706 - DNA, 2125 bp, Homo sapiens
agtaatatgggcctgaactaggcaagtagatgtgtaaaggaaaaggaagtgatggattcaaaaggagaatgactagtagttggtgatagatattatatggaggagtgggagaagttgaaggtgatgtgagtttttgagaatatgagacaagattaatagaaatggagaagtattatagtagagagaattagtgtttgtgggaggaagatgaatttggtttataattgactgatttcaaagtgtaagtggtaaggtagatcattagaaataaaagactagaaattagggccacagaagtaagtttgggagctatgaagtaataaaattatagcatattggagctagaaaagacttcataagcatctagtccaatcacctcagaggctccaagagattcaacttgtataagttctccaaggtaaatacagtactaagcctggggtcctgttttcctggcttcctaatccagtggaaactgtaccatgctatttcctctagtgaaaatgaggttaaaaatgaatcagaggtacagagaggagcatggggtcagataggggtgaaagtaacaaagagaaatgccatcgctgtttgtgttgtacttgctctccttgggaccagaattaacttcacttggggtttcttggaaggcacgtagccattgctaccctaaaatcttgagatcttttctagctccagtattagctggcacgcttgtttctgaagttcctaaggaagattggagaccttagtttccagctatcttcacagagttgccagttaaagcagttcttatcaccatgactgttctatttgaggttctactagactatcaaggcatttttttaaaccaccaatccctatatttctgaccaagcatttgaagtataaatcataagggaattttctctttcttgcaattagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagtaagttacaatttaaagagtcaagatttttagtattagttctattaaggttaaacattagactgcttcttcaattgatttgacaaatcatcagacatcagtattgtgagcacgagtgactaatggagccattttgactgacttgaaagaaaatgagagctgacaggtcagctttgatattcagttactctcaagcttgtgtaccattctcactgtgtcttcctttcattatcacaggaatagcagctttcgctccaagctgcatcttgtagacctcgctggatcagaaagacagaagaaaaccaaggctgaaggggatcgtctaaaagagggtaagagagtaattaaggtcacagttgtagattaaaaacttctagtactcttgttggtattgttggtgttttcgactgggatttgagatcacattctaacagtagctacgattcagatttgaggctgagttcagaaatagcgaaaaattgtttctttcccttgctctcattctctaattcaggtatgagatttggatctggcctttggtttgatttcatctggtccaggcaagttttagttttagttttgttttgttttgttttaccccaactatttataattaaaatcagtatcctgattctgtcattttaagtattcaccatcccttccagatgttgtcacatataaacctcagcccaatttccatgccttcattcaagttgttgaatttgaaaagtgatgaaattcctaaggctagaagaaccctgtgatgtaggctattagaaaccttcttctaacattatagtgacctggtaatctgcatgccttggtaatgatcttgaagtgattattaatctctctaacaaaaattaacatccagctctatatctcaattttgttcttaaggatatcataaaatagttcatcagatgccttgctaaatccagatacaccatatctactgtatttctcatagctaccagcttagtaacaatacaaaaaagaaataagggattttagcctaaagtgctttttcttggtga

SEQ ID NO: 137707 - DNA, 2472 bp, Homo sapiens
ttgctgccaactttttatatcagttctctcctgcatattttttcttatgttggtctgattcatctgctttcagtctctcaaggattttgtggtttctgatccaccagtgatggattcacaggaagttggtggctttcccacttggcagcctattcaaagacttttaggggctctaaaggaattttactcaattgcattagagggttttacatacacattctgggttgcccatcttagcttcagagcttcaatttcctcatttgtaaaataggatttgaatatattctccaatagagttgtgggaattaagtgaactcatattcgtaaaacatttaatgcaattcttagtaaatagtagtctcttcataattaccaattccatcatctgtgtttttacttgctctgagtgtggctaatgaggaatataggggctctactgatatttatatacaatctcagctgaactaagatccctatgagcttgctaaggtgcttgtcaacatttgaggtagatttcgagggtggaagaaacttttagggatatggcttatacctgtggaattaacttttctttggctaccaaactgccattgtcaaaggcaagtcctccactgttagagggaatcattttctacttatcaagaactaagaaagttgctaaaccctctggaatattttcagaaggtggatatggcccggcagaatattgttacatgttgcattactgtggattgggggaaaggagatgtacccaagtgtcagatttgactcgtgaggcaaagaagtttatgacagaatcatagttgagtcctacatcaagtggcagatgccaagagttgaagggaagctagtgagaaaacaggagataggtatataggaagcagacagcagatggaaagattttggacatgtcagatttggagtacatattagaaaaatccaggaagaaatcagaaagtcaggacaagagcttagaagcaacatctgggctagagataaatatttggaatccatgggtaggagagttgtgcagagaaagactggacaatcaaagagccactagtaaatattaaataatattagtaaatactaaatatgagcgaggggcactcatatttaagggccaagggtaaatgagtcaataagagaagctgaagagacactggaggatcatagtatctagataaccaagggtttttataaacaaaaaggactgtcacctgtgtcatatgcttcagtgtgattactgagaagaggtaaatagatttgtccgttgaggttttgggtgatctttgtcagagcagtgtcggtcgagtggtaaggaattaggacaggttgtatcaaactaaggggtgaatttagccaccattctaaatgtggtgtttatcctttccattaatttctttattcttatatcctttaatgatatgtagtgacattttgcatgtttctaaacttaatgtaaggggtttcatggtatatgtgtcttctgaaactgattttttccctcaacattatgttcttgagatcaattcatcttgataatatagctctgttctaacaggttttgttaactagaggcttgagttttcttggtatcaaattgtatcagtaagaagaaagttacctctgccaatatttattcctttatttaattctcttatgtttcttagcaatgagaaaaatgtcagcagatataccctggactagtaaagttgctttcctcaggggaatctagtttctgatttaaatcagaatggttttaatgttttattatttggaatgataattgctattggtgttggtaaatggtatttaattctcttagttctaaagtcttttttaagtgcaaattgtctgtttcattcagcaactctattcattaaagtcctgttctaagtgttctgcatgttctttttggcttctgggtccctttaggtgtattgttattttccttggtctgctctctgggactgaagtctaatgctggagtatctgaagtcatagcagcccagtgagtgggaaaagcacagtggtttctgcccatgagctagcaggcgtattgccagtcagcttgtcaaacccatgaggaggcatcaggaggaggcctctctgtactcttgtttccttgtgctttcttagtctcaaggtagagaggacccaacccatctcattgttttcttagcattttcagatggggaaacctggcacactcacataagcagtattgactttccccctaggagttcagagtggtatgggcgaagcctttgccacagaccatgtttccatccttgcactttggctctgctacaccacactcttagcccagggcttttctctgttccagagatgaaaaattctacatcaccccttactctcaggtctcagacccatcctgcaacctacttttttggctggccccagcacctacttggcttaagaacagtcaatgaatcaggtttgggaata

SEQ ID NO: 137708 - DNA, 1033 bp, Homo sapiens
ccaacacacaatcaaaccatctacaacatagccacgttttaagactcaacttaagtgttggggttttcgacattgccttttttaatcatgttatcttctaatgtatttttttctcctctgagatttctctagtaccacaggactacattgtcattttctggtgcctctgtatttctagcttcatctcccaccattttcccacaaactacaaggttccagccatagcagtctactcattgtttttccaaacagttctgttgtttcagatctctgtgccattactcctgtgtgttttctgctggattttctccccactgcctcagaaacatggttctgtcaagtactcctgctcctcctgttttaacttctccctctcaactgactttctgccctcagcatagaagcatactaatatttccccaacttaaaataaacaaaatatttcatcctcctcttactactgctctcctcccttttcctttcattctacatttttgtcacccctccatcctcctcccattgaaactatcccttttgaagtcaactcatgacctgaacaactgaatccattaggctcttttcagtcctccactgacttggtaattctgcaggtctgacatcctgccccttcttctggacaatctcattcctcttgactctgtgatgctaccctctcctgattttcctctcacttttctgaagactctttcacaggcttctcctcttccactcacccctatctgaaacataacccaggctttgtcctgggatattttctttctcttcccactgttcatgcccatcaccctgtcaccctccccccccaaagtggtttcacccacttagatgcttataattcctacctgtatgctgccaatcctaaacctctatctcgagcccctatctcataagtcatatttaagtatgtaaatatagttgactgtggggagtcttatggatgtcccacatgtatctcccattccacatgtccaaaactgagcccctcattcctccctgttgctgttttttttaa

SEQ ID NO: 137709 - DNA, 1043 bp, Homo sapiens
ctggcctgagtccccaaagtccattatgtcattcttatggctctgtgtccttgtagattatccaagtttttctactccattaataataacttaaatatagatagccctttacaaatcacatttgatttttatcccagtcccattaggtaagatcggtattttccctgttttatggataaaagaaagtttcagtggctagttcaatattatacacattggtgaatggcagaggcagaattttaactaagattctctctctcctaatgaagtgcctttcctactctatcccctatcgctggttgcctctatatgttttgtgatccatttcagtaacaatcattccctttctctttgaccaggcagaccatctatcataccatacttctgtttttcaccctaatttactcagccattctacctgctttaggcccatacatattttcttcacacgtagagcagggtttcccagctgtggcaccgttaatattttggatcaaataattgtttacggggaaggaggctgtcctatgcattgtaggatgttttacaacatctttggcctttacccgatgaatgccagtggcacacataccccactcctaagttgtgacaaccagaatgtctccagatattgccaaatgtcccctatgaagcagaattgcccctagttgagaaccactgcatatagatctacatttctctcctacctcatttttcttttttcttacaaatatgcttttatattccagctgtaaaacccattgtaatgtgcctccatgatagctgtgaagttatatttctcttttaaagttaaaatctctcctttattatttatttgttgccatagtgaacaaacacccaaaggtattgagtagcatttttgactctccttacttgatctgttctcattcttacagagaaaactacttcatttttcttcatagctgtccttaatcagaacttttaagtctctgcaaatatgttcttccccatctttgtgatatatattccatctttgggaatcatttatcattttaatgtct

SEQ ID NO: 137710 - DNA, 1190 bp, Homo sapiens
atcagaaatcttagatatgtatacatttcctattatttcaatataaaaaacactaagaactttttcttatagctctgaattttaagtcaccaacccgaatggacggctttgcttatatcctacttgtttgatttcatttcctttcgttattctttattgttctttttcagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtataagggacttaaagtttgatgggaaaaattacaagtatgtgagtggaatgatagagcttctgttttcagtttcttctttatcagaagtttagagatgttggttaggcattatgtttgttcggggacctcttaaaataactcctattaacgtgtttgctgtccatttaagattgggggtagcattggaaagttcactgatgaagaagtgagcagtgagagatgagatgagaggtgtagacaggggctaaattctgaagttccttatatgacttgttaaagaatttggaattcaacctgaaagctatgaagagccattgaagagttttaagtaggagggtgatatgataaaatgtgtgttttggcgagatcattctagcaggtatagagaaaatagattagaagtgggcatgactagaagaaggaaaataaatcactgcacaaaacaaagagagttctagagagaagaaacataggtagcaaagtacagttgattctcgaacaataggagtttggtccaacaaaacacagatcaaaaatacagtatttgcaggatgagaaacccatgtgtagactttttatacatgtggattctgcagggctgaccgcaggactggactatgcatctacatttttgtatacgcacagggtcctggaaccaatcccctgcatatacataggaacagctgtatagtggccaggagcactgacactgcaattagcccacccatgttcaaatcttagctctataactcactggctatgtaccttgggcaagttctctgtgccttggtatccctatctgtacagtagaaataataataataccttcttcttagggttt

SEQ ID NO: 137711 - DNA, 1030 bp, Homo sapiens
acaatattaaaaaggattttaagccaggtagtaacttgataatttacatttttaaacaatggcctggctgctgtatagaaatggattatagtagagcaagagtagattcatggagaccatttaagaaggtactgcagtagtctaagcgagagataatgatggcttggacttagagtgctggcagtggtgatagaaagaagtaaccaatgaattagataaaggaatgacacccagatttctggcatgtggaactggatattcactgacctgggttacactggaaaaggaccaggtttgaggataccagacaactaagtggaaatatcaggtagatagttgaatataaaagtataaagttcagaaagatctgtgcttgaggtaaatttggaagtcaccagtttcaggtaatagaaaccagaggcagagatgagacattcagaagagaatataaggagaatgtaagtaagaaaactcctactgagctttgggggactttaccatttaaaggacaagtggagcaaagatgaaccaagaaagagacttagaagatcagttagaagaatagaaggaaaagcaggaaaatgtgtcttgtaagccaaatgctaccagtcagtcagtcaagtaaaatgaagactggaaaatgctcactggatttggtgacatgcagctcgtttgtaacttgggcaagttatttcattggaacaatgtaggcagtcatattggagtaagttgaggagcaaccgagtggcgagcgaaaggaaatggaggcaattggtgtattattctctcaaactttgtgaaaaaagagaaaaatagggcaagagagataggaagtggggttggggaggatgcttttgtttttaagatgggagagacttgaacatattttaatctgaataggaaggatcttatagaaagggagaaattgaaaatatagaagagagaagggataacagtgtaagattcataagatggcaagaagagtgggaatccaaagcacatgcaaggagaccagtcttgggaggcagaa

SEQ ID NO: 137712 - DNA, 1061 bp, Homo sapiens
gtagattgtaaacttgagagtaggggtcatattttatttttatatgtccgtacgttgtctagcccagtgctgagactgattttcaaaaataggtactcaaggccaggagcagtggcttacatgtgtaagccccgcactttgggaggacgaggtaggtggatcaattgaggtcagcaattcaagaccaggctggccaacatggtgaaaccctgtctctacaaaaaatacaaaaattagctgggtgtgttggcgggcgcctgtagtcccagctacttgggaggctgaggcaggagaatcacttgaacctgggaggcagaagtgccactgcactccaccctgggcgacagagcaagactctgtctccaaaaaaaaaaaaaagaaaagaaaagaaaaaagaaaaataggtgctcagtaaaaactcattaagatgtagataaaatggacaactcatcttctacttaatagttgttcatgtaatgctgattttcctgttatcattggatcatcaactatgtatgatgcctttggtagtatctaaggtatgctatctgccttagatttcatagacatttagtaaaattactttattgctaattgtggtaattttactgccaagggttaagtagcatttggttggtgactagctgattatttttctttgcttctcccaggtacaacagctacaagtcttgttgctacaggcccatggaggtaccctgcctggatctataacgtaagagtcatagattaatttgaattgtgtattctaatagaggctatttttcctaataatagtttttccctggtttctgctagcacttggtgtcacggtaaggatcttaccaattttgctgactatttaggacttagttatgtttgaagcagcctaatgtaacagaaagagcatgggttctggcctcagaaatttattaattggaattctattgtgaggaagagctgtctcttcttctccatttgtttatttgacatttagttatatttgtatagattcatggatatttattttattctatggtttaacatccagtactattatttgt

SEQ ID NO: 137713 - DNA, 1036 bp, Homo sapiens
tattttacagagaaataaagatgctccttttcacaagaatgtatatttatatttttagagacattttataaggcttgttaacaaaaagtacattttacatatatgaatgttttcactttttgtccttagattattttcttttgttttttaacatgtcattgaagcttttgtatttattttctgtgagtgtcggtcaatttgcacatgctcagtttacttgaattcctagccttggcaattaaatagcatgtgaaaacattggttttctgttatattttctttttcagtctgatttttgcctggccctagtcctgtttttgctttacttttaaagattttacccattacgtggctgtcctatatcacgtggtcctataatatatctataatcttgccaagaactcttttttttccttattactgtgagagcttttatatccagtattctctgcattcatatagtacctatctctgtagtcagcatggtagttaagagcatggactctgaaactagactgctgagctcaaatttcagcttcacattacctactagctgtgtggctataggttatttaacttctttgtgcctcagtttccctagttataaaatgaggataacagtagaacttacctcataggggctattgggagaacttaaaaaatttaatgtatgtaaagtatttagaatagagcctagcccataatgctatagaagagttaactattattaattatagtggtatttaaatattcaagcatttgcctcaaattacaatgaagaacctacttctatgtgctaaattttccttggaaaaatcaacagttaaacttaaatatgattttcccatttagagaaatcctggaaattttttagggaaataaaaaactatcgagttaaaagtatcattactttgaagcttgtcagcttacatgaatgacacatggaagttttcagtttaataaagaaataacgaaataacacttaaatttactaatagttttttttataatctgcattttaattgaacattccttc

SEQ ID NO: 137714 - DNA, 1049 bp, Homo sapiens
cttcctagctatgtaatcttactaagtgctgtattactatcaaaaggaaagaatttaagtgattcaaataggggttaaaagcattattcatctgggcgcagtagctcttgcctgtaatcccagcactttgggaggccaaggtgggcggatcacctgaggtctggagttcaaaactagcctggccaaaatggtgaaaccctgtttctactgaaaatacaaaaattagccaggtgtagtggcatgcacctgtagtcccaggtacttgggaggctgaggcaggagaactgcttgaacccaggagatggaggttgcagtgagccgagattgtgccactgcactccagcctggatgacagagcgagacttcatctcaaaaaaaaaaaaaaaagaagaagaagaagcattatttagctgatgcactcagggtacacttgaactccaggtaacttcccaagtaaagcaagattggagctttatagagtaaagagaagaaagggttgtatgtccgtgtggtttagctcaggtaacagtttttaatgttaattgatgtgaaacttttggttggagattgtttcatttttttatacctcttcctcaggaatatactgatgcaatcctatccggataactgttattatattttgagagttgttcttacaagccttgtagtttctcagttggtcaaggttcacaggtgggagaggtggcaaaatagggataacggggaaaggaggcgagggttgaaggcaaggaaaattgggaatcctctctcgtgtgctttcttttatatcagcaatgtaagcaaagtgcagtgggatcataaaacaaaggatgattaactgttagtccagaaaattcaggaaggcatcatagaagaaactgggtcctaaaaatgaacaggagtttgccatgcagacaaaagggaagggacaggccaactctgggcacactgcttacgagttagccctgctccacaaggaaaaatttaagagcttttatataaaataaataaggttttttaaaaagggactagactatatatagaggaaa

SEQ ID NO: 137715 - DNA, 1050 bp, Homo sapiens
ctctgattagtccttatactgaaaattgaaacatgggagggaggaaagggtaaccattatagattttttttaatcctttttaagaatgatttagggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaagaatgatttagtatgtcctgcacttggagaatcaccagtactacaaatcatcatgagaaaggatgtgggaatactgaagcttcctttaaattctctttgagcctcactggttgggagtttctgagcagaataagggaaatgcttcataaatagcacttattaaggatctcttcaggccaggcgcagtggcttacgcctgtaatccaaactctttgagagaccgaggcaggtggaaccctggagcccaagagcttgagatcagcctaggcaacacagtgagaccttgtctctacaaaaaaataaaataaaatgagaccatccttcatgacatagtgagaccctgtctacaaaaaagttttttgtttttttgttttttttagtatttattgatcattcttgggtgtttctcagagagggggatgtggcagggtcataggataatagtggagagaaggttggcagataaacacgtgaacaaaggtctctggctttcctaggcagaggtccctgcagccttctgcagtgtttgtgtccctgggtacttgagattagggagtgatgatgactcttaacgagcatgctgccttcaagcatctgtttaacaaagcacatcttgcaccgcccttaatccatttaaccctgagttgacacagcacatgttt

SEQ ID NO: 137716 - DNA, 1019 bp, Homo sapiens
gatctcgaactcctgacctcttgacctgcctgccttggcctcccaaagcgctgggattacaggcataagccaccgtgcctggctaggcatttatttctttatagaggaagatcctgctaccttgactgactataaaaataaaaaataaccattctatttacttttctgatgcattgccattatttgatatgtctgttcgtagaatggtatgtccccataagaactggctaggcttgtacattaatagaggtatactaagcggtagatgcataaaaagaaagggtagagtccataaaatgggttaaactttggccttttggaatggctaaatgtttcactctggcccaaatgtctctggcagggcaggagaagtgcaagaaatatgtcagttgccacatgaccttattttttataagagctacacaattgtcctttatgaagaagaaagactcttgagagatgggaaatggaaacgtgactattggggtttctgtaactataaaatgggtccaatatcttaaacagtctctgtatacacttaaaaaaaattaaataaccaatataaaatccaccagtaagctttacttcagactctttccctaaaccaaaacatttgttactgcaggatgaaactgttgcttgcatggctgcagccattgatactgcggtggagcaagaagccgtaagtaattggcccctttgtgtagaaccaggagctctaactgccgtttcctataatttatcactcaactgaaaaagagaacctgtgattgttaccatcctccatagaatgcctgttaaatccagaaatctttagtgtaaatctcagcttcataaaatccctaccttggataggctctaccactaatagtataactggtaatggggggcaggacttctcaagaatgtaatgttccatatttgcaacccagctgactgatttcttgttagaggctagtattctgcatcaaccgtccagcaagttaaaaatgaggagaggaaaaaatgaggaaattatg

SEQ ID NO: 137717 - DNA, 1026 bp, Homo sapiens
tatatataaaattctatgtttaacacattttatttggtataaacacacacgtgtgtgtgtgtatatactatatacttacatcaattatatattctagtaatggatattatgtgatatgtaatatataatacatttgtttaatatataatcatgcaccaaataatgacatttcagtcagtgacagaccatggatacaatgatagtcccataagattgtaatactgtatttttactgtaccattatgtttagatacaaaataccattatgttataattgcccacagtattcagtacagtcatatgatgtacagtcacatgatatacagttttatagcctaggagcaataggctataccatatagcctgggtgtatagtaggctatactatatagatttgtataagtgcacactatcatgttcacacaatgatgaaattgcttaacaatgcgtttctcagaatgtattcctgttattaagtgacatatgactgtaaatgtctagatatgtaatatttgactatgtaaatgtctgcaaaaaatggaaggtatgcatcaagctgataacagtgcttacttctggagggggactggaattttggcagggttgaggcagtcaaggagacttgacctttacaagtattatctatttttttatataaatatatttatatgttacttctataagtaaaaatatagaatatatttttctataagtatagataaatatagaatatatgtaatatagaatatatgatatactatatatagaatatatgtaatatagaatatatcatatatattctgtatgtatagaatatagaataaatgtagaatatatcaaataaagaatatatgaatatacacatacatacatacacacccatgttattagtggttttaaatatgcagggtagtttgggcgtggtggctcatgcctataatcccaatactttgggaggccaagggaggtggatcacttaagctcaggagttcgagaccagcctggccaacatggtgaaaccctgtc

SEQ ID NO: 137718 - DNA, 2031 bp, Homo sapiens
tatatatatacatatatacgtgtatatatatatatacgtatatatacacatatatatacatatatacacatatacgtatatatatatacacacacatgtacacacacacacacacacatacacacacacacacacacacaaactcttttctgaacagaaaccaaaactaaaagatgaagtgactttccttaaagatacttatatagtaagcgtggcagtcaagattaaaacccagaccctcagattccaaacatttcctactacataattttaatctccatcaaatcaagagtaaatgttttcagcgtgcagttgaagtggtaaaaattaatgcatagttccttgagacatggaatgctgaagtgatttttcttcctgtgccatataatgtcttctttctctttgacctataacctttctaggataacataaaagagctagaattagaagtcatcaatctgcaaaaggaaaaggaagaattggttcttgaacttcagacagcaaagaaggatgccaaccaagccaagtaagaataaagttaataaatgttatttcaagtccctactatgtgtgaggagctttgcaagaaatagagaagtagaagtcccatttactgcccctaaagatttaaacctaattatgaagaggaaacctaaacacaaaaaatggttaaataattgcaattttaaatagcgtctcaagttgacagtaaaagaatgtcataacacagcacatgattagtagccaaataaatttcttaggcagtaattgtgttaagagttcagaggcgaggaatatcaattcaggctaccatgatcaaggaaggctttgtaaaaagttagcatttgagctggcttttgaaagattatcacacttactagataacagcagtttctttgtccctgcactaatggtaaattagcttgtgaatggaattaatgtccaggctagtgatttaaaaaatcaatctagccatctcttaccagttaagaataaaaccaaagcagataaccataacatcctactctccttcagacctctgccgtatgggctatcctaccttctttttactcagtgactccgttttatctctcagttgagtctaaagctcatgtttgtaaaagttatgctgaatgtttactttctatctcagacttgtataataatcatcagaattattcttcatagctaaagtgaagtgaaatgccttcaaagaaccattttgatgcaaaaggggcggcgtatattgaggcagttgcattgctgtgtactaaaagttgtcttactctttgtattaagctcctattattgagacaggtttggttgtttgggtggtattctttttttaagatggctatgtgactagtcacctattttatatatgtcagtgttgtaactctgggagtctagtattatgtcttttgaagtcaggctttgctgctggtagtcctcacttctacagcatctgtgtttaggttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacgggtaataaattctcatccttgcatttacccccattggaatttacaaacataggtattccatttagaaatatactagaggtgttttcaggtgagaaaatagcaggcagagcaatcatttcaagtgtgtgaatctccacaaatgtcccttttgcagaacattgtgctagtggtcatctaggatctgcttaataaaacgttgctttgacattcaaaatttaatgttagagtctctgaaaccaaagaacaaagacatctccatacttagtgggttatatcctgatcaccttccatgatcatgcagcataattttgtaaagtagtaataagatgacagacacctagagaaaattctcagttattgaatgttcaacttgtggcaccaacaaagtggtggttacaggctacttgtactg

SEQ ID NO: 137719 - DNA, 1012 bp, Homo sapiens
ttgcagtaagccaagatcgcaccattgcactccaaactgggtgacagtgaaactctgtctcaaaaagaaaaaaaagtatacaatttgatgagtttggacacgtgtatacacccatgaaatcatcaccataatcaagataatgacagtgtgcttcattgcctaaactttctttgtatccctctgtaatcccttcttcttatccctctgtaatcccttcttctcctccctggtctacccgtctactccccatttcatatatatttctttatatccccacagtggttccaggcaaccattaatctgctttctgtcactatggatttgttttcatctggaatcatacattatgtattttttttctggcttttattcacaattattttgagattcatccatgtggttgcatatgtcatatacaacttctttcctttttattgctgagtggcatcccattcattgtatggctataccataatttgtttttatatccatctgttgatggatacttgagtggtttccagtttttggctcttacaaatattgcactgaacatttgtgcacaagcctgtgtggattttttttaatttcttttgagtagatagctaggagtaaaatggctttcttgtatggttggtgtatgttttaactgctaagtggctgccaaactgttttccaaagcagttgtaccattttacattcctactagcaatgtataagggttctagttgctacacattcttgccaataattagtatggtcagtcttttgaattttagctattctgtgtgggtgggtagtggaacctcattgtggttctaattttcttttctgtaatgactaatgatgttggacatcctttcatgtgcttatttgccatatgtatgttttcttttgtgaaatatgtgttcaaatctgtccccatttttaaattgggttgtttatctttttcttattattgaattaaaattctttatatattctagatatatttaacagaggacttctgtgtttt

SEQ ID NO: 137720 - DNA, 1059 bp, Homo sapiens
agctttttttttttttccatagacaggatctcactctgttacccaggctggagtgcagtggcgtgaccatagttcactgtaacctcggatacctggactcaagtgattctcccatctcagtctcccgactagctgagactacattcatataccaccatacctggctaatttttctactttttgtagagacagggtctcactatgttgctcaggctggtcttgaactatgggcctgaagtgatcctcccaaagtgctgggactacaggtgtgagccactgtgcccagccatgtctagcttttttaatccaatctgaaaatctctacaacttaattggggtgtttagaccatttacatttaatgtgattattgatacaggtaggtttgagctatcatcttgctatttgttttctattgtgtcatctgttcttcattttctttttccctgctttttccttttttggatcagttgaacatttttatgatttatattatctttgtttacttgtacatgattttgtttcatgtattttggtgctttgttattagggacgtacacattaaggattatattctattgaacaatcggctcctttatcatgaatcctttttatccctagttttattttttgataggaattctactccatctgattctaatataatcactctggctttcttttgattactattagcatggtataccttcattaaaagcagaaatattctcagggatagttactgtttcaaaaagtgaattttggctgggcatggtggctcacacctgtaatcccagcactttgggaggccaaggtgggtggatcacttgaggccagcagttcaagaccagcctggccaacatggtgaaaccccatctgtactaaaaatacaaaaattagccaggcgtggtggcgcgtgcttgtaatcccagctacttgggtggctgaggcacaagaattgcttgaacctgggaggcagaggttgcagtgagccgagatcacgccactgcactccagcctgggcgacagagcgacaccctgtctaaataaataaataaaaa

SEQ ID NO: 137721 - DNA, 1052 bp, Homo sapiens
caggctacttgcaataaggcttactgtttctttccctgaaggagtgctcagattgctgacctacagcagaagctgctggatgcagaaagtgaagacagaccaaaacaacgctgggagaatattgccaccattctggaagccaagtgtgccctgaaatatttgattggagaggtaaacatcactctaaccagcagttaggaggctggctgtgtaggttgaaatgggatgttagccttgaaatattgtcaaagtgttattgccacttttcatggtagaaaccctaataacactaacattagagagtttagtagataaaggttggtgtaagcaagtacaggccagtcacttacaaaaatataatatgactcacaaattgatgcccgttgtgactggcctatagcaagtgctgaatgcgtgttagctgttgttattaggaaagaccagaatgccatagtgggtcactggctaaacatcaactgttatactgtactactttttaaaacccctatgagatgtatattcaaaaatttaagatccagtctagaaaagggaaaacctaagcatcttttgacatataaagattcattttagggaaaagccatctttgctgaccttaaaatgatatgtcaccttacgttgtcacaagaggaatgaaaattgattgcctctggtgattgaagcattttcactcaagataagcatacaaactccaaacccacaagtttaaacaatgctaccctttatacatttttgtgttagcttagcagatttgttctactaaggaaatcttgatcagtcttgtgaacactggtacttatgatgttcaccatctgggctagtagtgaatgtaaaactaggccagtgtaggatatgtagcctgaagagccagatctgcagtctcagtctacaagttctaacatgtgaatatagacattctgaaatgggacataattggccataagggtgtgtcctgtggattttgcttaaaaattaaggaagaacttcttaaatatcagaatttgtaattgtcagatactattcgggttagcttt

SEQ ID NO: 137722 - DNA, 1042 bp, Homo sapiens
aaaaaaaagacttctaacatagataggcaagctagaagtcaggctaagaactgtagaagtagcagagaccttaaggatcctctattcctgtggtttttcagtttgcgttcaagagtcatgtagtagctccatgaaagggcctccaggcagaggggcatggccccttcctccctcctcccatctctatctgtctctctctcggactcagttttcttaactgaaaggaacacccagtatggatgctaaaagagatattgcaaattgtagagagggggagtttagtcaaacaaatgaccgaggcttgtctttgctttaaacctggccttgtgagatgtcccatgcaactacctagtctttgccttcagaggccacctacaggcattgctccattccttcagggacagagcgtgtcaaacactatgacctccccaagcagggcctccctaagacttgcttcagctgactaatcaggcacttagagctgttacctctttggttgaatgggagcagactgattttgtaaacctggcagccaaatttataatatgcctgtctgcttgattttcaggatagcttgggcactgttgaacggacccaggattccgaaggctccttcaaactggaggatcctaccgaggtgaccccaggattgagcttctttaatcccgtctgtgccacccccaatagcaaggtaggtgggctaaaaggcaggcattggaaaactggattagcgtccttctctgcattatctatgagagaccagtaggagagaggcaggtggagtaaaggtgtaatcagcttgctgggaactagggatcgggcatagactctagtctggttttttccatagaatgatcttaaagaacacttcatactactgggagtatgtcgagcatctatagcagctcggctgggctgagcttctgcccctttctaaagtctattcatacctgtctctgtccctcctagatcctgaaagagatgtgcgatgtggagcaggtgctgtcaaagaagactcccccagctccctccccttttgacc

SEQ ID NO: 137723 - DNA, 1085 bp, Homo sapiens
aggggggagcggtggggcaacccaggagggctggagagtgggggcctagaggcctgggatgcagtaggggtcgctggggctccaagcctgtggaccccgagccctagcattgcagctgggcaaagagaggcggtgggaaatgtgtggttccctgtgtgtgtctgtttgggggtctccattagaagactgggaggagccgtgtgtcagggggtaagggcatggcggaggggcacattttcctgtgtgggggaattgggtttgtctcagtgtgggggtttggcaatgtctctgtgtctggcagggggcgggaggttctgcgggggctgtgtgtggtgtgtgtctccaccggaggggaggggagggggcatggtgctctgcgtaggggggacatatgtgtgtgtatgtatgttggggtgtgtggaggaaggcaatggagctgccgtgaatccgtgtggaggagcccatgtgcccggctcgctgagcttcatcccttgatgccatgagtccctctccgtcccagtccctttgtgtgtgaatgtgcacatggatgtgtggagatgtcactctgaatgtggagaggtctctgtagaggaggctgcagggatggctgtgtttgtgtgtgtggctacatgtatatgtgtgtgagcatgtggctgcaagagtgtgcacgcgtgtgcctggtgtgtgtgtgtgagtgtgtgtttgtatgtgttgtctctggtgagaggcgcttgacaggcaagggaggggagaggaaggaggcgagagacatgtcccaagcaaggctgagaggctgctgagaaggacggactcttttgtccaagcagctctgtagtgtgtgtgccggggtggggtggcggggggcggggggagatttgaaggaactgaagcaagcctcctcgctctagagcaggcatggtgcctggagccggcaaggggcagctgccctggtgcagagactggccccagtggggcatgtcccccttgggtacctccagatgtgagagggcttagccccccagccctgacttggcacagcttgggagcccctgggtgctgggcacaactccggcttccactcccag

SEQ ID NO: 137724 - DNA, 1047 bp, Homo sapiens
gattctttcaaatacctggtttgcttaatgtgggtttaacccataatgaagtataggaactgtgtctttctatttgaactttgtattgtgcccagcatgggtgctttacaggtgtttttatgatgaggctttggaaaatattaaaatagaaatagaaatgctaaatgataagataccacagtaagagatactatttagtggtttcactcctgattgctctaaacggttatggacacagcaatcctacctattagctaaaaatagcatgatgttcttggacatgtataatactgcttaaaattcaattgaaaatttaaacaactggctcttggcaaaggctctcttaaaatctattctaaaatgaaaaatatttttctgtgacttgtggaattgtcccaccaagggaaggatgggttatgtgttagaacattttgagatctcctacattttccccgtagtgactttatatcagcctctgtttataaactgatctagtatttttcttgaaagcccttttgtttttagagtagaaactgatctcaaaaacaggaggtgagccagaaattggtcattaaggtagcttaactgggaaatgatcctttatgaccagtcttttcgggaatgtaaatccaggcaggctgggggtacaaggagtgagagagaatgagagtatttctgtaagttattttaaggtgctgaataagcatacttttaccatggaaacacctttgggtaaggcctggaagagttagaaatcagtggtgttaataacttgaaagcataaaagggatattttccccataacatttaagtaaccattctatctccccctttttgagaatgaaggatgtaaatgtaactgctatcctatcagcattgaaagcacaaaggtgagagtataccaaggcagggagtcaaagttctgaaattcccgttgtcatcctaaaagaaggcaaggtaaggaagaaagaaaatgatttcctatcagcagcatttgtacactgtgaacaatttgaaggcagctagtattacatttatctttgtgtc

SEQ ID NO: 137725 - DNA, 1003 bp, Homo sapiens
ttttcacttagcataatgttttcaagattcatgtgtgttatagcatgtatcagtacttaattcctttttctttctttcttttttttttttttttttttttttgagacagagcctcactctgttacccaggctggagtgcagtggcatgatctcggctcactgcaacttctgcctcccaggttcaagcgattctcctgcctcagcctcctgagtagctgggactacagatgtgcaccaccatgcccagctattttttgtatttttggtagcaatggggtttcgccatgttagccaggctggtctcaaactcctgacctcaggtgatccacccacctcggcctcccagcctcccaaagtgctaggattacaggcgcgagccaccatacccggccacttgattactttttatggctgaacaatatttcatcctatggttatgccacattttgtctatccattcttgagttgatggacatttgggttgtttccaccttttgactattgtgaacactgctgctatgaacattaatatacaagtttttgtatgaacatgttttcagttctcttaggtgatatatgcttaggagtagaattgctaggtcataggtaacttagtgtttagcatttttgaggaactgtctggctttttttaaaagtagctacacccttttaggcccagccctgttctatatacttagaaaagaaaaaaagattacgttttcttttcaattttgccccctggagctgaacttcatatgtgtgtgtttgttttgggcttttctttattctatgtaacccaaggacatggtgctagatttagtaaagcactctgaatttagctggtcaggtgctttctcgtctttgttagatggtttgaggcaaaatcctaggagctttggtgtctgtaaaacatcagtttttcctgatagggtagaatgattagaataacagtaatgagaatgagttatttctttttattttattttattttatttttttgaga

SEQ ID NO: 137726 - DNA, 1059 bp, Homo sapiens
caccatgcctggccaacatggatgagttttcatgatgtatcagaaaatgaaaaaagcttgcgtgtgaattgtgagtacatgtatataagccatatatgcatggaagtaagtctggaaggacacatactaaaaataccaacagtggtatcttctggggagtgggatggagaagtgatacagaatttttaaaaagtgtaaactcagcagctttctttgcaggcacataagactgtggcatctttagggctttcctttcctgaaggatttgcaattgtattaccaagttttatttttgagagcttatccactctctggccccacctttcttttcagagacactgcaggatccaattctgtaagttaagaccagcagctccaaactttatcagaatcacactgatgcttgttaaaatgcagattcctgggcccctgctcagtagattctgattctgtgtatctgggatggggtgccaaatcctgatcttttagaggcaccccaacttgtcagtgactggggcaaaacccttcttcggtactgacttctgattgtgccccctcccacttgtttctctgtgattagcaactgggaaaaaggaaagagggcgatgactggatatctttgtgggtcacaaacagttgggttcatctgaatgggaaaaaacaaagcagtttagtagacttgagattttagtgttgcttctttgaagtgggccctctgggttagaggctggtcaggtgggcttcctaggcggtgactttggcctaggagatgtcctccagcattggctgcgatggctgtgttagtgacaaatcagagggaaggagggagcttggcgagtcctgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaac

SEQ ID NO: 137727 - DNA, 1043 bp, Homo sapiens
aagcaactgccatgacctgctgctaagttggagttcagcgggcaagtcgattccaaagaagggaatatataaacaagtttcaagaaggggaaaacatggcttaaagatagattgggtgtacttttttgttcacagttcaatgcatagttctttctctctttgacttatcttcccctaagaaagggctgcctggtcagaaatctttgtctcacacggttctgcccatagccggtgagctcagaggagggccagaaaggaacaaatgagaaacaatccccacccagtgtagagggccaagccctggggtggggccagcacccaggcggtctccagaggtagactggcctgctgttatgctctaggacagtccagggcttaggttggggcacctcattgatattgatggcttgccgtgtaaccctcagaacaggaacattgtccagctgttgtctctctaccctccgccaccccaccccccgcaacgtttaatgggtgagtcagtgacttaactgcttcctccaggatttcaggaacaggagtaggtaatgaggacaaatcaccataacaccggcgtgtgatgaatgaaagagcacacgaatttaacccgttggttaaactgatatcacagtgaacaaaagaaactttgttgagaggaggttatttgcctcactccattccttcccctttaggctttagcaattccccttacacccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaat

SEQ ID NO: 137728 - DNA, 1048 bp, Homo sapiens
cactagcccgaaaggaagcgtgcatctgcttttcagtgtggtagtgtggctctgaacagctctggaaagctccaggggagcagaaacctgactctctgtcagggatcagtgggtgacttcttagtcttcaaatttagtgactggttcactggttctctgacattgttctgacctcttcaccacatttgtttccatgaattacctgctttcttctttaaaggctctctttctaccctgcttaccattccttaatacctttcattagctctgcccccctaaatggcaatgtcatttattttcacagcttcaaatcctgccgtataaatgacattcctgatctctttactgaactacagacctgcatatctactacttgctggacatgtgcataaataaaactgccctctcagcgcctcaaacaagcggcatgtactttccttatctaagttaattgcctcaccctatcatgtggaaaagggattagatttgttctgtcacccaaggcagatctctgctcaacataaggaaggaagagctaatgattaaaactgtctgaaaatggaatggactgcttccggatatagtaaattcgatctttagtcactcaaggtgttacagaagaggctgggcaaccatttgcctgggtattgcagagggggttgaaactaaagcaataatctgaacatgatctgctcaaaagctttcactagttcctcagtgtcttcaagataaaggggaacaaacatttagggaacacattgttcatcaagacctttgttattctctttaaatggcttttaatatccctttaataatcctacagagtagatattatgattcccattttgcagatgagaaaactgagactccagttagatagctaagaagttcaaaaactggaacttgaacttggttgctctgactataaagtgtggttctttcagtgtttccccaacttcctcataggaatcagctggaatgctagtaaaaatacagattcccaggctccttttctagtgctttggattcatcaggtttgggaaaatac

SEQ ID NO: 137729 - DNA, 1080 bp, Homo sapiens
tggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaagga

SEQ ID NO: 137730 - DNA, 1045 bp, Homo sapiens
aatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgacagaatgtcttccttgctttaggaaatgcaggactcaggcagtgagaatgcattcagttttgattctgtcacacatagcccggaatgcacctctcggacagcacctccttgtctgctgcctctgccattctccttactgctttgagtgtgtaaattgaggggaaaaaagggctttttgttagagtttgggtattttcattttcaaatcatctgacgctgatttttaagaactctgtttcaagagctgtaagcagtaggtgagtatttcactcttcatggttttactacatcctatctcatttgggcttgcatatggtaagatagtgtgttttacttgcagcttccaactgagccaaaggccacagtattgcaggtagaagtcaaagtcttggaactagattttgggctgtgtgtgcaaaggtgtgaaaacaccttattaacagagaatatgaagaagacagcctaga

SEQ ID NO: 137731 - DNA, 1073 bp, Homo sapiens
gggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagcttcacaggccaaagaacttctggagcagtagagggaagagagacgtggagtagatgtgtatatcagtggtaccttagggcatgtgtccaggaggctacagtgacctttgttctttaggaagtaccagtgagtgttatgagtgtctggattatgtagaaacttctaacatccctacaacattttcttgtaaacataattttcctcttacatcaactttcatttaatctcatagactccatttgtgagagatggtcttttatttagctcaccgttgtctccattttagtttttcttgcatgctttaaaatccattgttctgtttttttttttcttctgtccttcccctccatcttcatgttctttcacagtcgatcaaaacgaaacgtaaaaagagtttccgcctctctcgaaagtttccattttacaagagcaaagaaaacatggcccaggagagcagcatacaggaacgtaagtagcagcagagtccagagagcaggccatctgcagccccatcctctcatcctcagttgcccttccctcgagagaagcctgggcagggccacgtgtggcctcgtgcctgcctgtgtgcgtgtgcacctgcttatctacagagtcagggcagaaactggtctgcctaaggagatgttgggttttatttgtcctgctcct

SEQ ID NO: 137732 - DNA, 1503 bp, Homo sapiens
gatgtgctatggaccacagtaataattttgttttcctcttcactttagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctg

SEQ ID NO: 137733 - DNA, 1087 bp, Homo sapiens
cactatctcagttcgctgcaacatccgcctcccgggtcccagcgattcttctgactcagcctcctaagtagctgggattacaggcgcgtgccaccacgcctggctaatttttgtatttttagtagagatggagtctctccatgttggccaggctggtcttgaactcctgggctcaagtgatccacctgcctcggcctcccaaagtgctggggttacaggtgtgagccaccacgcctggcccagttactcttattatccatgttttccagatggggaaaccaaggcacacagctaataagtagcagagctatgagcccaaaacaggctgtctggctgtagcagctgtgctcttcagcacaccaggcccaggctgcatctcactttgctctgcttagaacattttcttgccccatctctttgcatctgtcttcctctcctagactcctcgttgagagcagagactatgtcctgttcacctttataccccccgcacttagtacagtatctggcacatagtagatgcttggtaaaagaaaagagctgcactggtctttggctcaagcttggagggaagtgatttgaccaggtccaaacctgtggcgagtgtgaattattttggtttgttttatggagagcttcttttctgaagccactgccgcttcctctgggatttcactccatcattatgactcctctttttcatcttcttcatccatttctgatcctttattgctccttccccttcttttcactctactgtcttctcacccagggttgaaccttttacccgctctgctctcctttactaccatcactcgtttatgcaacacaagttgatcaagcatctagaagccctcaaagaccagccattaccttccaagcatgaaattccaagaccctagacgggaaaatgccttgctctccccgatgacttcacttctctcccatcctgccccaccccttccatgggctcctcccacctacagctcggttccctctgctctcttcccccacccctaagtgctgccattgctctagtcacccaggtttaagccctgatctccccactctggtcatcatatccgat

SEQ ID NO: 137734 - DNA, 1671 bp, Homo sapiens
aaataatttgggttgtgcatggggaaatgaatggggagaaattatatgtaggacagaatgggagactgtgataataatccagttttaaaataatgagagtctagacaagggtagtgagagtggggtattaagcaggcaaaacattgctttcttttcttttaaaataagctaccttatctttaaatccctttacaaaattcattcccccacctcccaagagaaaatgtggatattctaggttctgaaaactgaagcagtcaggaagagaacttccacagattcctactacctctactcacacaccaggaatcacaccacatagtctgccttctcaactgccaccatagattagctatcatgttccttcctaaagccagtctctaaacttacacacttgtttctatcacctcttgcctttttctcactcactttgtcaacattttattctcttactggtttattcccatcagcatatgaacatgctcatttatcccatatcaaacaaacaaaaagtaagaaaacctcttgaccttccttctctcaccaactactccccaatttctcttcttccctttgtagttaaactcctctaaagatttgcctatatttactgtctccaattctctcttgagcttactccaatcaggcttttgccccaccactctaacaaaactgcttttgtcaaggtcaccaatgacctctttatcgtaaattgcagtggttaattctcagtcctcattgtatttgacctatcagcaacattcaatgcagttgatcactctttcctccttgaaacacagttggcttccaggacaccacattatccttatttttatcctacctcatgagtcactctttctttctcctttgctagttcctcttttctcttcaaccattctcagtgtcaaattatgagctcaggagaggaggtattagggagttgagaagaagggataaggtattaactattcattcagaaaagtaagaaagtgaatgactacggaagtgcaatatgcttgccagtagcactaaggccatttcatgaagttttaaaataaaacaagtagttgtatgtatttttttctggccacattcagctgatgagtggatgtaagcaccaaaatcagtagaaagttggacttaatcagagttgaggttttgccagatgaatacaataaagcaaaagaagggcaggaaaatcaaggaacaagggagtggttataattagtctccatggaatttaaactgggtatgcggtagaacatcaaggggatgagggacagtgaaaaactggtaacatcagtgggttgggggtcttactgcagttgaaggattgctggagtcagggtaatagaggtatcaagttggaaaggtaagaggcggtagacagaaagtagaatgtgtgaaagtaagagctggggtggagaactagggggagggagggagacacctagggcacaaaacttaaggaggaacttattctctgggtggtacaagtaaaggcttggtacttgtacaacactgagagcctccttaaatttttcaccctaggtgcttcactcacctcacctgtcccaccctactcctagccctgactgagagtgtgaaatgattgcaattgttagtaatgacagagtctagtgaatgactgtgggagtaaatggctaaggt

SEQ ID NO: 137735 - DNA, 1019 bp, Homo sapiens
ttgaacaaatgaagcaagatacaaagtagtacttactgtatgattccataaatgtaaatgccaagaacagtcaaaatgaatatatggtgttggacatcagggaattggttacccctatttgaaacagggtctgaaaagaagcatgagtgggcttgttgctgttaatgttctgtttcttaacttttttgttgttaacatacatgtgtttactttgggaaaattcgtagagcctagaattcataagagcatagagctcttgagatttttatacttttctgtaagtcttttatacttcaatgaagaaaaatagaatttaaaaaacactactagaagtgaaacaatttgggaagataatgataaactttgtggtactgacctgaagtatgcagaagggcatatagaaaaggagattatcaagattagctagagtagttgtaggagccttttggtaggagacaggcctttttggggtccacacagttaaaagggaggaagaaaatgactccaggcaagggatctagatgggagatgtctaagaaggaaataaggatggaagataggatacaagcttgattaaaatggaatattcatattccatattgtaagtttagtgaggtaatactatgcagtaattttttatttcatgccagcagtcatttatttgaggtgtaatttatatacagtaaacttcacaagtctcaagtgtacagcttgatgagttttaatatatagtagtcttgtatattacaccatacagatcaagatacaaaaacttcccaacacccccaaaagttcccttggccccattctagttaatacccacctctacttccaagaacaaaaaaacaccattctgacttttactactctagattatttttgactgtttttgagctttgtataaatggaatcatacagttgtcctgttttatgtctggcttttttaaaacatacattgtgagattcgttcattttgttacgtcttttggatgatttgacactttcactgttatgaaata

SEQ ID NO: 137736 - DNA, 5052 bp, Homo sapiens
tggggggtctgggggctgtgtctgtttgaagccccgggggaagcccctgggtggagctctgtttaattcccaaatagccacaggccaaggaactgacacattaggtttcaagattcctgggttgagattaggataaaccctatcagtttctggcaagagaaagagacctaatattgattgagcacttactaggcgccagccactctacttcagggggctttcacgtgccatttctgaaattagcccttccaaaaaccttgtaaggtattgtaattcctacttgtttatgaagaaactgaggttagaggtaaagtgacttgcctttgtcccttccatatccccgtcctcatttcccaatagctcctttgcttggtggagggggtcttgtaattcgctttcagagtttagggataatgagccctgtcgaggggtttttgtcttgtttttcaccagatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtgagatatggtgggggagggagggaactgcacagccagcaaaggggtttttggtcaggaaatctgggtggaagtattctttatattattcacaggacctcaatctccctaaatgtgcgggtttgctgggggtctgggggggggtgttgaaggtgtggagaaattgctcattctatccatctccgtcctggtttccttaattaagtgaatggttttggttcttaaaaagtaataataggccaggtgcagtggctcacgcctataatcccaacactttgggaagccgaggcagacagatcacctgaggtcaggagttcaagaccagcctggccaacctggtgaaaccctgtctctactaaaaatacaaaagttagccgcgcagggtggcttacacctgtagtcccaactactcaggaggttgaggcaggagaatctcttgaacctaggaggcagaggttgcagggagaggagattgtgccactgcactccatcctgggtgacagagtgagacttggtctcaaaacaaaacaaaagtaagaataggtgaaaaaggcagggacttgtgtgagcctggggtctgggaagaagggaacttggccacatgtttctctctctgctacaccaggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggtgaggcaaagagcagggtataatggtgggggttgggccaggaggggctagtccttggggccagggataaggatgggggatgggcctgagaaaggcttaagggaggtgataatggtggggaagaagaaaagctgggaaggaacctagaggcagggaaacaaagcttggactgaagactttctgggagtcctgaatgcatttctcccacaggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctataggttagatggtcactcttaggagctgcagagctgggaaaatgaaggggaagaaggggatctgctgaaggattctggatggggatgggaaaaaatgggaggctgggctttgaagacctagctaactggtttggcattagagaaaagatacagagttggctgaacacacccttaccttctccaacccttcttccactctagcttgggtcctctgggctctggaggatttgtgcctttcggcttcgagggaattctccgtggagcagcgacctgtttctatgcatttgttggtttcgactgtattgctaccactggtaacacagtcattccattctgtttggggcttgggcacagtgtgtgcccaggctgtatgcagactgggggtggtagaggagtgggcctgcttccctaatttagaaccttacgcccttccttcaggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccaggtcagtatcaaatgtttgttttcttctgctgtcagagtctcaggttatagcattcagtaccagagaataccccttaaaagggctgtgaggggaaagtggagactctttaaacatacagtcttgggaagagagatcccagtcaactcatgccaccctgggcattctcctctccagcctcctgggctccatgttccccatgcctcgggtgatctacgcgatggcagaggatggcctcctgttccgtgtacttgctcggatccacaccggcacacgcaccccaatcatagccaccgtggtctctggcattattgcaggtaacagaccctctttccccttcccttagttgtttcgccaacttctttaactttgccactcccttctctcatttcttgtttcctgcctattaattttagcattcatggcattcctcttcaaactcactgatcttgtggacctcatgtcaattgggaccctgcttgcttactccctggtgtcgatttgtgttctcatcctcaggtgagactcttcctctgcatactgtgatttggatttttattcttggatgaggaatgatggagatctgctcctctttcctccttcgccttcattattccaactttctttgaggaatctgggtatctcaccctgccaaaaagaacttcccttaatggtgatgaggaaggttaagctgcctgggagaagatgataaagtgagtaaaggttgttcttaatactgccatcttacttttgcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttggtgagcagtggaatttttctggggtggctctgagatcagcgtgattgggtcgaagtgtgtggcatttggtggctgaggaagaactagagagagagcgactctccttggaacagggtttctaatgtcttagcatgttggtcttaagagttggttttgatgtctctcaacttgacctttgaagctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtaaatgaactctgtcttttttccttgccagcccatcttgggagaataggctccagatatcttgaggtctaataaagttcatagatattctttaattgaacatgaaagggaagatataggaggtacctaggccaaagacttcttctctgaccctctttagttcctttccagttccatttacccaaactgcatattcttggagtctcatgaggtatgctaaatgagcagctactgaaatgcagaggacaagtaagagttggactcacccttttctggcctgcataggatagggatctctttctaggtcaacctgtggtatgtacaaagaagattttactttgttttcaggtgcctgctttgcctctcctcccactaatgagcatctttgtgaatatttaccttatgatgcagatgacagctggtacctgggcccgatttggggtctggatgctgattggtaggtatccacttgggaagagtaggcttctttggtgtcctagcccagctcctttccctcttggtctcaagtaggaaacctatgaagcctttacacccccacctcacagctacctttccccactaggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtagaaaaataaactgtgtcctgttttttgcttgctaaagatgtagagcctgacttttaagagtgaagagcctcagagaagtgtcctttgtgttttcttcagttaccacaaaagcatctgctgtgcctgtgggtgcttcttgttgaatcagggtttgaggagggtggt

SEQ ID NO: 137737 - DNA, 1112 bp, Homo sapiens
actgagagtgaggtggagactcccctgctgtgttccgcttcactcctgacacacacacacacacacacacacacacacacacacacacgcacccaactcccccccatcacaccccacctaccttccccattcctgcccagaatcactggtcctaacagggcacagaggtggaaaatctcatgggttctttggccaggaagcctcttattgtcctgttctgacgaccagcgagacaaatgggaaaagactgccctcccccttttctcgctccccggcacgccaggcttgctagtgaggatgggacgcagtctcaggccccacgcaatccttttgcaaagccaagaagtgtgtgtgttgtgtgtgtgtgtgtgtgtgtgtgtgtgtgtgtgtgtgtgtattgtgtgtagcgaggaggattgggggtgggatcccatgacgttaccggctccgcctcctggtgtatataaggggcgcttggcgcgcaacgaccccaagccgcagctttgaagcctgagcggccgaactcggcagctccaacccaactcggcttaactccgcctcaccgagcccagtccaagactctgtgctccctaggtttgcaacagctctctggtaagcgttggggacccacacgtgtgtcggaggggggacggcgagggtccgggcgtacctaggattctctggcaaccatggcatgcagttgcatcaacggggccgtgacctgttgctggcgagacccccgccccgggagttagggctcccgtctccaccccagctccaaaccatttctagatgggggcaggaaaatctgggacctgagtcggggggcatcgggtggaacccttcctctctgctgagaggagagtgcgagcaatctcgggctgccctggggcccctctgggggcgcatctccaaatctttagatgtcgaagccccgcctcgctgttgatgcttgcaggtcagcctagcagggcttgggaggaagtaggggaacatttgcttactcccctgggcgacagctgcgctagttgagcagtgtgggcttggtgaggagggatggaattgagtcggtgctcacttttaatctgcagcgaggttggtcccctctccct

SEQ ID NO: 137738 - DNA, 1048 bp, Homo sapiens
gggatcataaggagccaatgggggcacttcttttttttttttttttggcatatgaaaatttattactacagggttttcaccattaatatttatgatcttggtctttccttcttgcctttgtatagggccaaaagagaaacattggctactttgacaaccttaaagcggactccaggaatatcaccaacagcatgacctttgcgaccaaatccagcaaccagaacttcatcattttcctcaataaagtttaagcaaccgtcgttgggtacaaaggctgtgattttcttgccattcttgatcagctggacccttacacacttcctaatggcagaatttggctgtttggcttcaactcctactttttccagcacgattccttttgcatgataagcacctccaaaagggttggcctttagggctggggggcacttctttcacaggttttcagttcaccccctagttttcggactcccttcttattttgaccttgagcacttcctagctctgaaacaggaacctctctgggattctgccaggcacgttggcttgttccattctgtttcatcagttgacacacttccaatcttccaaaaatttgttaagcccattttcttcactcttaagggcttattcttttattaccattttaatgggatgtcaaaagggagggagataagcacatatctttaatcagacatcttcaatcagacatcttcatttagaactctcttatctttataatggctttatagtagacctttgtgtggatgtaatatagtttattaaatgcccaggtgatggacatttgggttctttccagtttttcactattcaagcaatgttatagtggacatcttttgtacgtaaatctttgggcacctgtgcaagtatttctataagataaattcatagaagtaaaattggtagatattgccaaatcattctcttaaaacattgatccccttcacacactcaaaacagcaaaaagtggaaatttcttccctacatcttcacaacacattatcattaatcttttttcatctttgcc

SEQ ID NO: 137739 - DNA, 1070 bp, Homo sapiens
tctttttgttttaaaaatttatttcttttcatcttctgtttctcttaaggcattatgttttgtgtttatttgctcttgagatccttctagtttagaattcatttctgattgttttcttttattttcaattatttatttagtcctattactcattttttgagtttttctagttctgatttattttgttatttcatatcttgtatcatttttaacgtctttttacttgttttgaaatagtagattatagtttttatgttttgtagtcatgtatttctgccatgctttcattgtcaaaggctgttattctccttattctctttattcttataataaatgcaaccttgaccctttctgttgaccatttctataggagtttttttttcttgtagaaggctgggttcagaatagattttctaatttcatggcttttagctccctcttctgttgcttttgtgtagttttttaaaatgtagcaactttctttctcagatatcttggcgctgttttactcctccactttcatctgaaccttcttttgctgtgctgctatgtttggattctattcccagcagtttcttttcaatgtggggatttgtcctggaatggagctttagctggttagttttgagagtgcatggggctcacactgttccagacccgtgaaactgcctttgcaaaaattctaacactgagaaaattatggcagtgaaggagatctgagctggctaaccccatcttgcctttggccttaaagctgcccttaattattcctgggcttaggccaaactaactttgggagacatttagcttatagtttaaatgataatagcccttccccaaaactcaaccacctttgtaaagctaatgagagaccaccaggctgagaggataaaggagcctgaattctaccaaggtgcaaacataaatgatttccagcccttattttggaggtcacacgatatgcatcttccccaattactcctgcagataatatcactattgtagaacctaagattggtcttttgaggtctcttttcaggttttttgcatgtctgatatcgatggcgcca

SEQ ID NO: 137740 - DNA, 1103 bp, Homo sapiens
ttcggacattgctggaagttaaaatcactccggaatgaaaaccactgctttagaggctcacaggacaaagccagtactgcccaggaagttcttcatttcaaagagagtgactcttccccagtcttttctcgctacaaagtcaatggtagacagcctgatgtgaacacaaattgaccttgaccagttctaagtcattgccctttttctgtgccctttatactcttccctctctacaggagatttctgttttcccttcccttgcaaaccccacccctacccccaccctttcaaccatatcgtccaacgttgtgcttggtgtgaaaatagcatcctatgggcagtagaatggtagtcacttagagtgtgtttgaattttctggtgaaatccaggccctttctgctaccaaactgaactctaggccctgaggttggttggctctccattctcatctctgcttctctgccacggtctcctttgtcgtagggaaatgccagtcatagtcatatttgtggaattccatccatagttttcaaaaagtggtggagtcaggtctgtctaaatccaatgcctttgtcttgcctctacccaagtcgttctcaaacttcagtgtggatcagaatttctcaaagctcaggttcccagactgagaaaagcaaacaaaaaacaaacaaaaactagcattcccagttaaatttgaagttgaatgtgtgtctcaaatattgcaaacttttatactaaaaatttattcactgttcatctgaaattcaaactcagtgagtgtcctgtattttatctagcaactctgtatagagagtttattaaaacacggattgctgggccccatccctagagattctgattcagtaggtttggatggggtctgagaatttgcatatgctggttcagacactacacttctgagaaccactggcatataggttaaatggtgaaagacaagacgttgcatctgtgaagtcttcccctcaaagtagcaaagcagaagggggaaaatggctaaaaagaaggtaactgcctgatcagaaatccatgtgtgaagatatatgaatttttattgataacaatagcgtgctagctattcaaa

SEQ ID NO: 137741 - DNA, 1029 bp, Homo sapiens
tgccctagaagatgttattcatttccctgactgaaacagatggtagaaaatgcaactcagcttacttactgttaaaacaaaccatctttttggacttttattatttggaattttcttataatagttatatttattttagaaattttagataatacagataaaaaataaaagaaaactggcagccctactccccaggaataatcaatattaacattttggtatatattctttcagtcttttttcccttatctgtaataggaggaaaatatgcaaatagccaacccccatggaaccacttccataaggcttctgtcagattccaaatgttcccaaggcttctatagtacttatgtaacaagccacacagtggattgattactgttaatgtatgtcctctgggagttgccaaggaggctcacactttcaattactgtacatcccagatttgaaagcatatccctaactatttgtcttaaggattttaatttttttctttcttgctactggatataagtgtctaacaattctcactgggaattgattagtgagtaggtattgtcaggtaacatgattaatgctgtaataagtatataggaaactaagaactcagaaaaagaattactcattgaaattttaataataactgtcatttaagagatgagattaactatgtggagaagtggtttacaactgtgttgctaatgaaaacataggaaataaccaagttaatcaaagtgcaactttagaactgggtggtaacttaaaaaagcatttctgccctccctcagctgcaggcatctcggcacagagacagagagagagagagagagagagagagaagagagagagagagagagactctgtttgtttgggtaaaagtaagggcagagaaaaaaagtttctgtctggtaatccagagaattctttcggatctgatccaagaccaccaaggcagtacctcaatgagtctgcaagagccacagtgttactgagcttggggtgccccctaacgtagatgtgactacagtg

SEQ ID NO: 137742 - DNA, 1038 bp, Homo sapiens
ctcactacagactcgaactcctaggctcaagcagtcctcccacctcagcctcccgagtagctgggactacaggcacacaccaccatgcccggctgcaatattttatttctatcaccatgtatcttacatctagtgggggatgatattgtgtaaacagaaatattacattctagtgtggtaactgccattgcagagtggtgaacagagtgctatgggaacacagagaacagaacaatcaactatgtttaatacacattgcctgtagcatagtggttaaaagttcaggttttgaagacctatatttaaatcccaccatttactagatgacaatgctatttagcccctttaaatctcagctttttcatctgtaaaatgataatagtagttatagaattgattgaggattaaaataagctaatgaacataaattgtttagcaaaactccttgataaataatagctagtttgtctttcccaagaagacacatactaaaggatgagtaggacattgtcaggtgaggaagaaagaaaaggacattctaagaggacaggatacaatgtgtgaagacatggagacattatagggcctgctgtgtttgtggaatggtgagaagcttagcatgcaggagtttgggggtggagtagagcgtgaggctaacaacctggactgaatcctaacatgctagaccaaggagttgtgttttatcctgtaggcaccgaggagtcaaaagagtgagttttgttttgtaaagatcatttcgaaagtagtgtggaagttgaacaggtgtagaatggagagagattggtggcaggactacttagcagacgtaatagtccaagctggacattatgagagtctgaaccaagatcgaggcagtatgggggaaaggctaggcttgacagaatgatatttatgagttaaaatcaacaggactgtatgctgattgattagatgtgcagcgttagggagaagggataattaaggcaaaagcaaaagcttctagcttaggaacatggcttgcgattgtgaatgagaatg

SEQ ID NO: 137743 - DNA, 1063 bp, Homo sapiens
agcccaggacttggaggctgcagtgaactatgatttcacaatatgaaatcatatgatttcatatgatatgatttcatgtgatatgattgtgctactatactccagcctgggcaacagagtgagatcctgcctctaaaaacaaataaataataaataaataaaatgttaccctcacatgaagcttttcttagctgtctctgggacacttagttgctttctgatctatattcccacagcactttattcatatttctcttctatcacttagctggattgttttgtaacctgtcagttaacatatctatttcccatttgatcagtgacttttaaactattttagaggtcatagatgatgtactataaactgtggaatctgtctagaaaaatacacatgtacgtatatatttacacagttgttcatcaggttcatgaacctcccaaaggacatgcacagactattcacctgcattagaatcactaggaatgcttgtttataaagcaacctgagttactaaatcagaatcttttgagggtaggcctcaaatatcttgaacaatcccaccaggtaattcttttattcactaggcttcaagaaccactgtcctagcttaaggacccccatggtagacagtgagttcttgagggcagagagtggatattattgatctttagatcttatctatcctaaaatcttattgatctttggatcttgttgatcctaagatctcaccatgtaatagagaccgggctaagaaagagatcatttttagccatggtgatcagaaaaggtagcaacaagagataagaatcacctgccccatggaaaataggttttcagtaggttgagatgaagtagtggaaaacactgtaggcacagagattggcagcagcaaaggagagaggctagaaagtgctatgtgtatccatggaaccagtaggatagtaggaaataaggccagagaggcggcttatttagtcattaactaaccatctcctcccaacacactatgtactagatactatgcaaaacattgagaataaatatatgaataagacatggctt

SEQ ID NO: 137744 - DNA, 1144 bp, Homo sapiens
tgcataattgctggcaatggagtggaggagaggagttgatcagctggaaaggagccttatagctgcttctatactagtactgtatatttgatattggttgacaacagcagaaaaattatttatcaccatgctggggacttattaaattgatttctactctgaagtaatatggaggaatttaatggttactcttagagatgtaatatttctttatttttcattctagcagccatcagaaaaaaaaatcacaaaaaatctattgcttgtacagtcctgtcatttgtgacctgggatattgtgctcttgggctgtcagaattccagtttatgaggcaatctgtgtcattctggtttagccaggtgagtagtcctctggctctgtagaaaagaacaagaaagaaaaataataaaaaaggggaatgtggaaaaatatagatatgaatcttagaccctagaggacaagttaaggcctgggttacaagcagcaaaacagagaggaggccccgggggttatggacacagtcagtagagtggtagtcattaattataaaaaccgagagaactaggagaactaagcctgtgtggggacctggcttgagttcaaaaatgaagaagcttacaatgaactataataaaaatatctgtgaaggcaaggttaaatagaaaggaagtatgctttcaagttaaaatgaatagaagcccaggcatggtgactcacgcctgtaatcctagcgctctgggaggccgaggtgagaggattgcttgaggtcagaagttcgagaccagcctggacaacataatgagaccctgtttctaaaaaaaactttttaaattagctggaaatgatggtgcactaatgtaatcccagctacttggaaggctgaggctagaggatttcttgagcccaggaatttcaggttgcagtgagctatgatggcaccactgcactctagccggggcagtagagtgaaaatatctatgaatatctgtctgtctcaaaaacaaacaaaaaacccaaaaagacccccaaaaaactaaaaatactaaaaatggatagaagtttaattataggctgggcatggtggcttgcgcctataatcccagcaatttggaaggctgaggtgggaggatcacttgagcctagg

SEQ ID NO: 137745 - DNA, 1042 bp, Homo sapiens
tggtgaaaccccgtctcaactaaaaatacaaaaaattagccgggcatggtggcgggtacctgtgctcacagctacttgggaggctgaggcagaagaatggcatgaacctgggtggcggagcttgcagtgagccgagatcgcaccactgcactccagcctgggcgacagagtgagactccatctcaaaaaaaaaaaaaaaatatatatatatataaaatatatagtatattatatatataatatatattatattatatatataatataatattaattatatatatatttctctagacagtaaactaaggaaactttttgaaattgttttgtttagatctcagtgaaatttgggaactgatattggtagctgggaagtaatttgacagctttggaatactgtgactatgacaaatgtgaaattggtatgtgtgataaattattaatgccaccaatagaattaaagttgactatagatcataattttggtaagaatgcagtttagtatcaaacagatttttccttgggctgtatccagtatactgtgatgaatttttgatctatttgtaattagaaaattggagcttaaaaaaatgtattgatgctgggcatggtggtgtgtgcctgtagtcccagttactcaggagacagaggcagtaggatgacttgagcccaggaatttgaggctgcagtaagctgtgattgcaccactgcactccacgctgggtgacagagtgagaactcatctctaaaaacatgcattgactttttggaatgacctttttatattcttttccaggactatttgcaacccacaatatatataggactactcaggatctgctttagtgtgagggttccatcttaattaccctagctatatttgatataattttatctttgtataaataagatacatagctagaagcatagaagagaaaatgtaaagcaacaatgagagtgaatcagagatgtagagctccagttaagaaaccctaagaatattaattgccggatgataatctggcacatattgagttctggc

SEQ ID NO: 137746 - DNA, 1088 bp, Homo sapiens
gtgattctcctgcctcagcctcctgagtagctgggattacaggcgcatgccaccacgcccagctaatttttgtatttttagtagagatggggtttcaccatgttggccaggatggtctcgatctcttgacctcgtgatctgcctgccttggcctcccaaagtgctgggattacaggcgtgagccactgcacccggccactaatttatgttttaaaagatcattcttaagtgttcttactacaaaaaagtatgtgatgtaatgcatatgttacttattagctcaatttagccattccacaatgtgtacatatttcaaaacatcatattgtataccataaatatatatactttttatttgccaactttaaaaaaagaacattctgttaggagtggaggatggaagggaagctggtgaccaggagtatataattttactcagcagtactttgtaagcaggaatggagaatataaatagtttggttgatttgtgggtgagaattgacataatagggatggtggaaaatcaaggggataggagaatagggagtgttggttactgttattgaagtctcactgtccatggactctttcctaagtagacaaggaaatgcagtccaaaagtacatgatggcaatggactttagggactcagggggaaagggtgggaagggggtgagggataaaagactacaaatatggtgcagtgtatactgctcgggtgatgagtacaccaaaatctcataaatcactactaaagaacttactcatgtaactaaacaccacctgttccccaaaaacctgtggaaataaattttttttaaataaaggaatttgagaccccccgccaaaaaaaaccaaaaaacccaaaagtacatgatggctttggaaaataggcaagagggttaatgaattaaaggccttgaggcagtttaagggtaaattcagggagtataaggtttaagagaagtagaacaacaagtagttctgagagtggaccctctgtgtttggttttggaagtagagccattccaagtgtcactccagcaacaaataattgatacctggcaggggagataccatgatcacaa

SEQ ID NO: 137747 - DNA, 1332 bp, Homo sapiens
aatcctttcaggtttatttgctaaatattcactggatccatatacttcaccttttttcctaatgccactaccctggtccaggtcactgtcatctcaaactttattgcaactgtctcctaattcatctacttgcccccactcttattttaccctcaaatcatgtcccacactatagccagagaatatattctaaaacaaaaacccttcagtgacttcccagtccccttaagagaaaattcaaaattctttaagtgacttacaaggccctacatctggctcctgcatcagcttcatttatcaccactcctcatctcacactctgtacctcagcaattctaaattccattttcaatgatcggtatatgccatgctctctttctcttgaatccaagccctcatacatgctaccccaatgtctggttggtccacttttagtgatactatggctgagcagtgtgtacagattgtggacagcttaatctttctattttaaaagtccttattgcctttctcatctaccctcattgttagaaaggcatcctcattgtcttagcatccactgatgatcattatctgaattattagtttcataagggtattccaaatggtgattttcctagttctgtcattccttctacactattttttttttgagtcagggtcttgctccgtcatccaagctggagtgcagtggcacgatcatggctcattgtaacttggaactcctgggctcaagcgaccctcctgcttcagcctcccaaagtgctggtattagaggtgtgagccacctcgcccagcttcttctacaactattaactgaaattcttctgtaaataattttcccttaccaactaggtctttttggtatcctaaaataaccatttgtacatgatgagtagaataaatgtttcttttgtgaatttttctttgtgcatatttttttgtgtatttttaaaaatttaagtatttaaattagtgatttgaagctttggacaattttgtcagagaaaccatttataagtagtggttatgtttccagaatagcagataaaaacttgcttaatccacagggtcaataaaatattacacatagcaataacaaatataaaatatttttgtaatattagttatgaaatgaaagaaaacagtttttaaagtttaacttgagtaccagtacttgagagaaaagcaatcttaattagaggaagaagaggtagatggatacttatggtgatgtgaagggatctgcagagtaatttcaaggacttttagaatttgacggcattggttctttttttttttttttttttttttttttttttgagacagagt

SEQ ID NO: 137748 - DNA, 1362 bp, Homo sapiens
gggagcttcttcaagctggtttctgtgtccattgacatgcctccatcattctttggcactttcttactttctgggacaacaggaatatttcaggcttatcatgtattttcctggccctaaccttggaatcagctatttctccaaggaagcctggctcccttaagtggggaatgatatttagcaaccaggatctctgtgctggggtatacttattgctactgaggtgtcatcactttggggctcctttagctgagagacctaggatttatcccaggcttttgaatcccttccaatatctccaccaagtgagtttagatctgtgcttgaatacttcattatttgaggaaattgctcgagagacagtctccttcattattgggcaaccctttatatttgaaaacagtggccattggtttcctctactaagtcttgtcttctctgtgctaaacatctgcagttcctttactgccattactctcatggcagagtttgaagatctcctcatcattctggttattctgttctgttcatacttcagctcatgaatatctctctttaaagattggcatctagaatgaaatgtactatttcaggtacatgttctgatcagtacagaagagtgggttagtgattttctttgttctagaccctatgctactactcatgcaggccaaaattgttagcttttttttcttttcttttcttgttttttttttttttgacagccacattgatcactctgttgaattatgttgagcctatagttagttgaaatcactaagactaaaaactcaactatatttatccatttggtacttaaatgcttatgttttaggacctagtatgaggctttaatttgatctctgtcttttcagcctaagaaatttagcttatcattcctgcttgtcaaacttcttttgactcctgaatgtcatccagttgtactagcttcttttccagtttatcatctgcaaatttgattagtatgccactaagtgtcttcatacaaatgactatcttaaaatatcaaaaaaggcagagcggagctcaaatatttgcagcctgactagacacctttcctatgttgaaatcaatccatcaaataagggattgctactgttcatctactttcacctgctgttgtatataggatctgacccaacagacctgtcacaatactaccttgaaccaatttctagtgttttcctgggattagtgtttcaaagttatagggaagcttgtttattgtaaaatggggacctttcacacagtccaaacgtgctattcttgagtggagatcgtcctggtgtggcttggtctgtgtcctccttggtgccagaggcaaagagaaatgtttgaggc

SEQ ID NO: 137749 - DNA, 1037 bp, Homo sapiens
acaaaagtgcctattttgttaaaatgttttattgtgataaaaattcaaaaattattaatgttagccaacaaaattcaagcaaaacataaatgtgtaaagtaaaaagtgaaagatttttccttagtccctctcaccactcccattctccaagaataacttaatttggtgtgtgtcttcccagatgttgttctgtttgtgtttatatattaatatacacatatatacatatatgaatacccacacatttgtatataggttttttttaaatgaaatgggatattatatgtactgttttgcaacttttttcactttgcattgtattctggacctcctcttgcattaatacatggaaatttacctcatttaaaaaatgactgcataacatttcatggtatggttgtatcacaatttaatgattcacctattgatgcaaatttgtctccaatcattcactattataaataatgctacatataaccttgctccagtgtgtaagtatttctgtaggatagattttgagagaaggaattgctgggtcaaaaggtgtgtgccttttactgtgtgtgtgtcttttactgtgtgtgtgtgtgtgtgtgtgtgtgtgtgtgtgtgtgtgtagagatgggggaggggggtggtctcactttgttgcccaagttggtctcgaactcctggcttcaaacgattctcctgcctcagcctcccaaagtgttgggattacaggcatgagccactgcgcctggcctcattttacgttttgatagctaaagctaaattgctttcttaaagaatgcagtttaggcttccagtgacagcaaatgagaatgtttccccacccaaagtggggaaattctgttcacaaaaatttccttgccaaaagtggtaaaaatttaaataattgataattatccaaactatttggtgaaaatcatatttcatggttttaatttgcattttctggtacatttagttgtaatgataccactgtcaggttttagtttccccacacatttacttttggtcgttctagaggcagt

SEQ ID NO: 137750 - DNA, 1026 bp, Homo sapiens
ctaccctttgacccattctttgagacaaggaattaagccagtaaaggtgggagaggtggataacattcaggcttctctggagttgatagttatcctacatgagatacttctatgttgaagatattcctacttctatgttgaaatatatgctgtaataatttaagtaaaattactttcttttgtggaaatgtagaacagctgctcactgaaatggatatttcttcatatccttgaaaactgttgagtcacccttagtattctcttcttagatataataagttctaatttttccttacttggctcatttttaacccttttatctttttattattctgaaatctctccaaggccctcacatgtcctcaagttgtagagtcttaaattggacaacactttaattacagcctgaaggttaggtagttgttattccatttatatatcttagtatttgagtttacttttgaaatataaagtcttagtgactaatttagcatgtggttctctgccactcccttcctgaccacccaccacccctcattcttatcttctttttttaccttgtttgtacaaaaaccagttgttgcctattttatttcttctgtccataccctgtctgtctatgcatttaaaaacagagaactcattccttataaaacagacaaaccagggataattgtcaacatcaaaaaagaattctttaaatcactgcaggcttcctttaaataggtgtttcctgtggtggttttaagtgtttttatataggtcatcaactgcttgatataaagaaactaaagataaagggttaagaggcagtgccagttgaagaacagttagaaattgggataaaacagtagttcttaggtaaacagtaaaatacattcagattcacagaaaaaaaatatgtatatatatattttttgagatggagtctcacagtgttgtccaggctggagtgcagtggcgtgatctcagctcactgcaatctctgcctcccaggttcaagcgatcctcctgcctcagcttccc

SEQ ID NO: 137751 - DNA, 3184 bp, Homo sapiens
agaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatatgtaatacatgtacataaacacacatgcatgtgttcatcctctgacacacccacacaacaccaacaaacatttcttctataggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggaggtagcagtcttgtcatttagaaaatcaaagctagttttgatgtagctcaacatggaaagaaggtacagaaagtgatgtgttcaaaacattagcaaattaaggctgaatgtggttggctcatgcctgtaatcccagcattttgggaggctgaggcaggaggattgcttgagcccaggaggttgagactagcctgggcaacagagtgagacactgtctctacaaaaaatttcaaaagaaaaaaaaaaaggaaattaatgttacttagcagtatttggttctaagtagaagagtgggggctgtgaggaagttgaggtttttggtagttcatgaatgagatgactaaaaatatctgaggggatagggaagaatgggtatttctgtgaaataaaggaaaggaagggtaaagagagatgcaaccttcataggcagcagtgttagagaatgaactgcagaataaatagaaaagcagctataaaataaagtgttaacaaaaatttggacagatgacaactcatttaacaagtgctaatagtcttctgtgtgtctggtcctatgctaacagcagggctggggatagggtggagtggttgtggtacaagtaaaatatgatattacattctcttttttcgtagaccttaagagttcagttgaagagatgtttagctgggcgtggtggcttatgcctgtaatcccagcactttgggaggattgcttgagcccaggagttggagactagcctgggcaaccgagtgagatctcatctctacaaaaaaaaaaaaaaaaaaaaattaaaaatctggccaggtatggtggcacatgatagtcccagctacttgggaggctgaagccggaggattgcttgagcccaggaggttgtggagtgagccatgcagtgagccatgattgtaccactgcactccagcctcaaaacaaaatgaagagatgtctatacaaggcaggaaaatgctagagacagagtaagagattca

SEQ ID NO: 137752 - DNA, 1070 bp, Homo sapiens
ctcctggattcaagtgatccttttgcctcagcctcacaagttgctgagattacaagtgtgtgccgccacacctggctaatttttgtatttttagtagagacagggtttcaccatgttggccaggctggtcttgaactcttgacctcaagtgatctgcctgccttggcctccaaaagtgctgggattacaggcgtgagccaccaagcctggtgaaaactcttatatgtacatatttacatactactgcaagtctacttgtaggataaattcaaagcagcaagggacttctgatcatcagctatgataaggttggatgtggtaagggttggtttttacctggtggtgatttgaaggggttataggagcatgatccataggagctatttcttcattgggacctgtccaagttactcagacaggtggctaccacaggctgaacattaccatctttcttctttaatttttccttccatgtagacaaacctacctatcttcaagctaaaggagtcctgcgtacggcggcgctacagtgactttgagtggctgaaaaatgagctggagagagatagcaaggtatggctttgttctctgtgtggcatctttggaggaggagctctgcataggctgagtgggcatacaaccacagtctataaagtcttgaagggaatgaagagggtgaacacattcttatccatcaaatctcagtattttagatcggggggataccttttgaaacttgaaagtggtaagttctggctgggcacagtggctcacgcctgtaatcccagcactttgggaggctgaggcgggcggatcacctgatgtcaggagttcaagaccagcctggccaacatggtgaaaccccgcctgtactaaaaatacaagaatcagccaggtgtggtggtggatgcctgtaatcccagctacttgggaggctgaggcatgggaattgcttgaacctgggaggcagaggttgcagttagctgagatcgtgccactgcactccagcctggatgacagagcaagactctgtctcaaaaaaaaaaaaaaaaaaaaaagaaagtggtaag

SEQ ID NO: 137753 - DNA, 1897 bp, Homo sapiens
ggctgctgcttggagcaaaacaaaagggaaacccggggggcggggggtggggggggttgataggggaatcggtgcgggaataagggaggccgcagccgcggggacccggaccctagtaagagtggcgagaagggaagaggcgggggaagggggagtcaggggaggggcaagtgacgcgggggagcggggcgtgggggagggcagcaatccgggtggaggaaatttgggaggagtgtccggggggcagcaacttaaaagggggagggaactgcggctaaggagacgttcggtgatgggagcgcaatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaaggtaattatgaccctcttaccttcttcccaacaccatctaccccctggaccccctagcctcccttacttctactctggggccccttttactacctcccacccccaccccctttgggaagcccagagatccaccttcaatctccagttagacaaacatttacttagtacatagtatatgccacactcggtgcttgatgctgaaggatcacagatgaataagacactgtccctgccctggagaaaattgaattctctgctcactgctcaatattcgcagcactttggcttgggctgccccaaacacttattcccacagagaagtctttatcctatgtacagcaggaactgtgtggattccccacatgaacctacccttccctcctcccccacctcccaccccaacaccttttctcccattcctgtgggattacttggattccctgcttgcctcccagtacctcagtgtagtggtactgttctagcactgctctacccaggaggagggagtgcagtggcaaagggtaaaaacaataatattcatggggaaaggtagctgatctcatgcactaagaagaaaaagggctgtgagctgccacttggctcagcttaccctgtgctgccaagaaactctcccttgtaaggggctatccaagttttggggggaagtcatcctttactgttaaggaatattagtcatgaagaaggaggtagggctctgactttagagcacaaagttgggagttctcttggccttctgtgaagaaactgtgagagaatatctcaaaggatactctgaaaaacttgtcctgaga

SEQ ID NO: 137754 - DNA, 1895 bp, Homo sapiens
ggactggacttcaactttgagccaggtacagtaccccctaatcaccacagcacctcatagcctattaccactcctaggtgcccagctagtcccatgatctgggcgaaggggagatttaggacaagtggtagccagagctcctggggaactggagggaagatgtcatattacagtagcatagtttccggatgggacctccaggccccttagctgtgcccagccctgcaaggtagcacagaaaaggtatgtgtatggaagcgggttaggtgccaccatcttctttggtgggaatctggatgatagaatgttggcaagccccaggtaagcctcttaccttgttctctgtttcttcttcccacagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagctctggtttctgctgccttgcttctccccttggataagggggagggaggggaaaaggcaaagggcgggaggaagaaa

SEQ ID NO: 137755 - DNA, 1006 bp, Homo sapiens
tggggtccaagtgaacgtaagggcccagctttaagtaacgatctgttctacacggaaccctcctcctgccctttcaccttgttccttcttttctcctgccctactctcccaccccttcccccttcccctaaggaaaaaacaactaaacgccgctttcctgcctcaggatgaactgacggccttgaatgtaaaacaaggtttcaataaccagcctgctgtctctggggatgagcatggcagtgccaagaacgtcagcttcaatcctgccaaggtgagacaactctgccaggctgaaggaaaaggctggaagaatctaagaaggagcaaaggccctgggttgggaagacttatagggacaacctaagtggctgagtttgccttcatgacctaatactatctcattggcatttgcccagcaaaaggcaggaccacctgtctgccccttcttcccaccctgaggtacacttttcttccctcagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtaaggtactgtttcctgtccttcaggccaaggagggagcatggggtaccaagtaccctcctattcccatattaagctacatgggtgtcagctcatggggataatagagacctcactatttgcaatgtccatccaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatgggtgagtaactcctaacaccaggtgtactgctgatggcttcaa

SEQ ID NO: 137756 - DNA, 3658 bp, Homo sapiens
cccttgccccatgatgtagaggtggcaatccggcagtgggattacaccgagaagctggccatgttcatgtttcaggtagagagtagggcatgctgtgtggggcattgggttgagcttgaacttgtactctgccagtagagaacagaatctgcctgccaccttgccccagttgtggttctcttcatcttttcatttactttatctgcttcatctctaatagtcccctcttccctcccctggtacccataggatggaatgctggacagacatgagttcctgacctgggtgcttgagtgttttgagaagatccgccctggagaggatgaattgcttaaactgctgctgcctctgcttctccgagtaaggcttggaattttggtactggtggggcagggggagtctaagaagaatttgaggaagaataaaatgttagagcagggtcccctggagagaactaggggctctgatggtcgtgtcttcacagtactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacaggtaggtactaggcgggcccaaggaagcattgagagatagcctgagaagaatcaggtgcccatcccagagaataggggtaattccaaattggatgtgggagtaggtgctgagtacttgcttggaggttgttgtttcttggtaatggggtgttagtcccctttgggggttttcaccagcctctctctcccttccaaggctaaatagtgggcccaaagccttttaggaaagtgagtgaagggaggggatcggggtggagtgatgcctgtcttggggacccagtcagaataactttggatctggaatctacgggttgggtcttagaatgggattccagaggggtaaccatggtgaatgagttggacttagctgtttctatctggtagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtatgtctgaccactagcctggtactctcagattgggctatgaggctaaattactctttcagaagtagtgatttggagtctagtactattcttctagcctggggctctggccttttatatgccttggtacatccttgtagccttcctttttaacattgcaggtccgtgcaaagttgcgggagatcgagcagcagatcaaggagcggggacaggcagttgaagttcgctggtctttcgataaatgccaggaagctactgcaggtatgtgtcagagaacagataataggaaatatgtttgaggaaaggatggggatagtaaggacatgtagatctaagagccagaatgcaccgggcctctggttcagtcccctttaccacttttcctccttaggcttcaccattggacgggtacttcatactttggaagtgctggacagccatagttttgaacgctctgacttcagcaactctcttgactccctttgtaaccgaatctttggattgggacctagcaaggatgggcatgaggtaagcgaaaaggggaatagaaggagcaaaaaacattgcaagagcaataatatgtctgagagggaagtcatggtgaggcattgaaagcagagcatatctgcagaaatgatcttactgggcccaggatgttttatgatagagcccagtctttaggaaattggaactcatttctttgtccccacccctaccttactcctccttctcttcctttgttctccagatctcctcagatgatgatgctgtggtgtcattgctatgtgaatgggctgtcagctgcaagcgttctggtcggcatcgtgctatggtggtagccaagctcctggagaagagacaggcggagattgaggctgaggttagagggcagagataagagaacaagattggccaatgggaaggaatttactgcggttggagaccgagagatggaggtggtggagggaccagagttgaaggtgtgagaacagagtaaagaagcaaaagagaacctaaaggcaaagttacggacgtgaggcgaaagtagagaagagtggattgtagtaagagttagagataacatcaaggcttcagttgggaggtggtaaagaacatggaggtcagcaggggaatgaaagtgaaaagcatggggtagaggtcaagcaggtggtagtttaaggcctacacattgaggagtgaagaagcaggtaaaagtcagttctacaatttgttctgtcatcttgcagcgttgtggagaatcagaagccgcagatgagaagggttccatcgcctctggctccctttctgctcccagtgctcccattttccaggatgtcctcctgcagtttctggatacacaggctcccatgctgagtacggacccctaccactctctagttacctctgcctagactcagttacccaccactgtcatcagaaagcataattaacagccctctggtctatatttctctcttgggctctatgcagaatgacttttagatgtagttctagtgatcctctttaactggtcatcttacagttaaacagagtagagaaatacagagaaggataaaaacaagagcttgtgattgaagcattttcactgcataaatcgcaacaaagatgttacattcctttctgagatgatgtgtgggacagcatgtggggtaaccaaccacactttgtccctcaacaatttctgggatttctatttgatcactcttattattgccttaggtgtgtccctctctcttttggcccacctttttgtgttctcctaacttatgtttcctcattcccttcctccagcggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagtgagtgggcttttccttgcactagatcgtttcttctgacatttccatcttcatggctcccaggggcctctaagagcctcttttgcctgggggaggggggtagtatttttcttagcacttggtgattgaccaagcactctcacatcaattgtttcattggttcctcccatcagccttgtgaggtactcttatccccattttcaaactgaagaaaacagaggcctatactggttaagtgattggatgaggcttgactccagatcctgtgctttccccaatctggtcttctctctccacttccccaatgaagttttacagatggtgggagccactccctagggctaaag

SEQ ID NO: 137757 - DNA, 1042 bp, Homo sapiens
ttgaggacatggagaagcctgatttctcagtaagttcaatcctgagcgtggcagaatctggatccttggatcttcccattatgcctgcttttggcatgtttttttgccccctcatccactttccttcttctcatgttctgctttctcacctttctctcagttgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggtactattccccagcaccttgtgatgatctgttttgaacccagattgctgtcaaaggaatttgctgaggggttggagctgttctgaggatgtgggttgggaaagggaagggctttagcatgtggatgctgaggggtgtggagcatgctttcaagaggagggaaggagatcggtgctggagtctgatggtgctgctgggatgcaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactggtgggtttgaggctccttaaacagatctcccccaaagaatgccctagtcagtcttcccttccccagtatagggaactccccagtcatgtcccaatgtcctgtctcttggagtctcctgagagctctagtccttttgaaacttcccccctcattccccccctctacagaccagcttgctcctattgtgcctctgaatcctggagacctgacattcttaggtacctcacagtaagccccatactgccctccctccctctcccttccctccctgaacctagcacctccctgtacatattcctttaaggtccacatagtctgtggtcctctaaacctttgcttcactgtccccttcccttcattcc

SEQ ID NO: 137758 - DNA, 2516 bp, Homo sapiens
ggtgtgggcctaagcccagcccctttcccacattctggcctcctgttctgttttccttttcttccctatcttctccctgctaggcaggctaagcctcctggtctcatccccttccagtgtcatcctttcctccttccctggttctttcctctctccactcccatctcactcccactgcccttatcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcaggtggggaagttggggagatgagggtggaggcaggagttcatgccatatagcggctacggagggtcataaggacaggcgtagaggctccagccagtttcccaagctatttgaaggggcagaaagactagcatggggggagtggaacatgagctaagactgcaggaatagagacttaagtgctccctggggaggccaagaggcagattagagcattgggcacagaccatcctcccactgtggagttcatagaactgtatcctggacactggttagaggtgttgttgatagaataaactatcaacaataaactatcaatagaggtgttgttgatagactgtggcatagggtaacgagcccttctatcctgtggtggctccagcaggaaggggctcaggcccagccttgccagcgtccccacaggaaggtggtttctatgtaacacaaggggcctctttgcatttctcacccccgtttactctgctagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggtaagcagagcttcggaataactgaaacaaagctctggcgaatgccggtggaagtggcctgggaagagcatgcacttcctcacactctggggaagcacctgctgctcaggtgggaaaagaatggtatttcccagaggcttgaatctgtttggaggagcccgcataccatctgctgaccctcccaaccttgcttcttcatgcaggctgtgtggcgtcgtgaagcatgggatgaaccggtccgatggctcctctgcagagcgctgtatccttgcttatctctatgatctgtacacctcctgtagccatttaaagaacaaatttggggagctcttcaggtaagagaggtggaaggtaaggggtagcgagtgggacctactcccttcttcccatgaccacccaactcaggaggagaggatggcccgggaccctgctgcctgtctagggtcatttgtggactgtgtcctccacatactgttgtgttaccaagagtgggccctcttcctcagcaggcttgctccccgcctatatctgtggggcccaccctcttcccccttttcctcactgccttcagaggccccagttccttattcccatgtggttcctttcctgcccagtctgttttgtcccatctcccttttcttgtctcaagatccttcatccctcactttctcctttttttcttttctcccctttcctgaccatccctcgacctcagcaggccttcttcaacactactatctcctttcctccatccctgcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgataggtatggggtgtactgagtgaggaagggcaccatgcccccatctgagatagggagggctgaggtacccgggaggtactacaaccttgattatttagtggggcagagatgagaagttaatgggtctgaggttttgtggagcaaggtttttcctgagggcatttgtacttttccctagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtgagacttggggtggggttttgctagtggggcagtgaccagggcagggggctggttgtgatcctctgaccagggacagagttccgtagagtggaggcacaccgctttgagtgggcctccacactgagtcatggtgtctgtctgttttttcctccaggtcagtgacctatcttttcatgactcgctggctacttttgttgccatcctcatcgctcggcagtgtttgctc

SEQ ID NO: 137759 - DNA, 1369 bp, Homo sapiens
acctgttttttagccctggatttgcagccctgacctttccaatttctgacccttcaactgcgtaacagttctctgctctacctcgctttcaatattatcttgctttttctcctttcactttacctcatcttctctcccatgcccctgccatacacttgcatgcatgcaggcacgcacacacataaacccacatacagtttaacttcatcccttccagatctgttttgtcttccttttagcttgtagtgaacaggactctgagccaggggcccggcttacctgccgcatcctccttcaccttttcaagacaccgcagctcaatccttgccagtctgatggaagtaagtgaccctgatctgaaccagccaacagtagaaagtgtggttcccctgcctccgtggattctacttttgcttcccctgacttcatcgccttccccagacaagcctacagtaggaatccgctcctcctgcgaccgccacctgctggctgcctcccagaaccgcatcgtggatggagccgtgtttgctgttctcaaggctgtgtttgtacttggtacgggggtaggaagggagtggtgccagaagtgtgtatagggtggagtgccagctaaactacaagggacagtctttctcccttctgaaggtggtctctctgacctttggggaggaggggagggagagaagtatatttctgtcccatagggcaggatttggggtgtttctacctctgtgggcccagggtgggtctccacacgtgttccaatctcactctgccctccctatctcccacccgtgaaccacaggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggtcagtttcaccttcctcccacacctcctaaatgcctctgtgtaatatagttctgtttccagcccatgatcacaccagctccctactatacattgtgttccttaacaactccagcccatcccccatattcctaaccccctcactggttgttcccagtccctgattgtcagcttcctcaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccaggtaggccaaggccgtgggggctgtggagg

SEQ ID NO: 137760 - DNA, 1499 bp, Homo sapiens
tcaactagtttggactatttaaatgtagtcttttttttttttttttttttgagacggagtctcgctcttgtcgctcaggctggagtacagtggtgcgatctcggctcactgcaacctctgcctcccaagttcaaacaattctcctgcctcagcctcctgagtaactgggattacaggtcgcccatcaccacgcccagctaatttttgtatttttagtagagatggggttttgccatgttggccaggctggtcttgaactcctgacctcaggtgatccgcctgtctcagcctccctaaatgtagtctttcttaaagatggggacatagaggtccctttcagacctccaggagtctgtgattcaatgttgcaggagatcaggaattggcctcagattgttgggtagctgggggtaacacgatgatgactagcctgggtgtggggcctctatcacagaacttggaccagtggaccatgcgccagtcttccttggagctgcagctcatgatcaagcagacccctaacaatgtgagtagtgcctggaccctccctttcctgtgctcacgttcagctccatgtgtcagggaggcggtccaccacagaagaacctagatcctacccttgggctcttgagctgagagataagaggggatgggaaaatggtgaacaagtggagctgatgataagggaaatgggttgagagtgttggagctctgagctgtggggaagcttggtggtggtggtggagcctgtttctctggccatagatgtaaggaggtatgtaaaggagaagacagtgaggaattggagaaatatggaggtactagagggcatgattcccaacagagttgcgttcctatctccccatcaatctccgccagtgttgtccttctccgtcatctccgatctctcctaccatctgctttccttcacccttagctacctattttagcacttctgtgcctttcatcctccccaggagatgaactccctcttggagaacatcgccaaggccacaatcgaggttttccaacagtcagcagagacagggtcatcttctggaagtactgcaagcaacatgcccagcagcagcaagaccaagcctgtgctcaggtcggatagaaacatgttaggacccatccccttaggagtttatctgctggtagcgtgagtgatatcagatgcgtggagatgccagcatgtccatcagggaaaggagaggatagattgttccagccttgcctggctcccctgtgaccctgtgtcctctgtctgttctccagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagaggtaaaggggcttagggagtggaccaagattgaggggtagaaaggagaagaggcagg

SEQ ID NO: 137761 - DNA, 1059 bp, Homo sapiens
cccacccatctatctggccgacagcctgtatctcttttatttctgtgtttccctacacccacccatctctgcacacttttatcttttccctctctgtcagttgcggtatttgttgagtaaccataattattgtgtatagtttaaaacccaaagtctaactccttcatatatacattctcttcatctgtcttcctagtccatctgtctcttttcctccgtctctgtctctctccctgtctgactcgtttgcctttctttgtctctccacctttttgtctctctcttcctgtttctttctctctctgactctttctcggcctgcctaaaggcagagtctctccctgccttcctctctctctttctctgccttcctttttctgtcttcctctgaatgtcaatccctctccctccccgctccctctctggctttctccccaacccctttctctcccgatcttctctccccacacgccccccgccccgttagttcatctcctctcctggtctgggctggcttcatcttgtgcctccacacctctccctgtgccccacccttcactctctccccgcataactctcttccgcatgtatatgtgtatccatgtctgtctgtctgcttcttaccatctctcctgaatctgcctatgactttctttctacccattcctacaaatgcttgcagtcttctgttttctaagtcccaacagcttattgtttttcattttctggagcagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaaga

SEQ ID NO: 137762 - DNA, 1053 bp, Homo sapiens
ttctttgctatcgggtctaacaacaactgcaccttggtttccattttttctgtccctggacttctgtcctgtctgagtgaagtttccaaggtcctttctctggacccatgcttctacctggactaatgcacaaggggttggggtcattgctgtttctctatcccagaaggcaagcccacccttgcagtagggtctgttttatcaggtcttttgaataacttctgagatcacctcttcaagatagcaacttgggggagattttaaagagagtctttggcagtgggaactggggagggttgcataacaacagcccgacaggatgttgggttggcgtgggagagggagactgacctcttcttccacctctccatcttgatgagactgtaatttgtgtcgtgacgccttctccctgtgccctgaactgtgctcttggatgtggctcatggagcctgtgttcttaatgagtctgaatcatttccctcccctatagacacgggtcctggaaaacggaagagagaagatgaagcccctatcttagagcagcgtgagaaccgcatgaatcccctccgctgccctgtcaagttctatgaattctatctctcaaaatggtgagttggtgggttggcaggaaaagcgttagcatggggacccgagggatctactttgccttggtactgatcttctgtcctgccacccccactcccactcccacccccgatgttgcagtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccc

SEQ ID NO: 137763 - DNA, 1924 bp, Homo sapiens
agcagtcagcctagttgtaccgggctcaactattcatatggtgtcaatgcttggaagtgctgggtgcagtcaaaatatgccaatggagaaaccagcaagggtgatgagctgcgctttggccgtaagtacttggggatggggggtgtggggaggcagggacagggaggaggaggggaaaggggagaaggggctgggcctgtgattcagctgaagatgtctagaagtgataagggtgtgatcccttaaggatgccctgtgaagatggggaggagttgtagattaaagggaaatgctgtctaggttccaggttaggggctctttctgtaattgttcaggagctaggcatgactaagggatggaggggttaatggtgatggagctaagtgaaattctccatgtagagtttttcttaatcctgtccctgcacaacatatcactgcagccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcaggtacctcttgtgcaccacctcacttcctgtcactcttaacacagcaggcagggtctaaacagaaatgattctgggttaggcacggtggctcacgcctgtaatcccaacactttgggaggctgaggcaggaggatcgcttcaagccaggagtttgagaccagcctgggcaacaaagtgatacccatctacccaaaaaatatttttttaatgaaaaaaaaaagcagttattctgttgcactccctgttcctcatcttgtcccctacctgaagcaggcagcttgcctttaatctcctactccaaatagaacatgagatatcaatactcttctaaaatcaaaactgcattccaggaccgttggccaaggagcagtcttcattgctatccaggtcccctttgtaatctttaagcccattctaggaggggagggatgggtggagctgggatccttgagtgctggggtaatgtttagttccccctgggagaagtcaaccatgtattacctgagaaggaggtgtgggcttctaaagaacatctcctccaagcctcctcctcttcgagcaaagcctgagtagcgcagagctgtgggtatacctgggggaaagcactcgaggccacctaatcaagcaactgtttcccatcgtctcctaatgatcaaggacaccatacctgggggcttcagcatcattatctttcttctaggacctacagtctagccttaggtgtgtctgtttttctttccccagtacttgctggaaaataaccggatggtgaacattttcacggacctttactacctgacttttgttcaagaactcaacaagtctctgagtacctggcagcccacactcctccccaacagtaaggaacagggacgtagcaacccctacccgctttctccattcttccaatccaccatcccgagagtcctgtgctgtttggtctgccactcttcacaaagggcccgagggcaggagcgtgtagctggatgcctcagggtttagagttaaaggagcacaggagcgcctgttcttgaacgtgagatggggatcaagacttaggtctgaagagctatctctaggaccagaaaaagatggcctgggtttgggtggtaagtaaagaaagaaagcaagaaatcgtgggactcctcaaggtttacatttacttgtctacaacttgagggtggtgagaggcgttccaaatgcaggtgtggaaagtatatattttttaaagcccagtcccactgtgtagtgtagcaagtgtagcgaagtgacagtgttttatatacaaaggttactcaccaaatgagaattgtgtgggaaatgagcaggg

SEQ ID NO: 137764 - DNA, 1093 bp, Homo sapiens
ttacagcttgtcctccctgccctgtgcccccacctcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggtaaggagatggggaagggcagaagacactataactcccagccagggagaatggaggagaagggagggaggccgggaaagtggtccatgaggcagggccttctgcccgggatgttctacccccatctcccctaaagttttgggcacaaggggctgcttagagagaggtttcaggtatagcaccttgaaaaggttgggtctcttgcccttgggtatctgtgtctctggactctctttcctcttctcctctttccaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggtaaggagggtcagcatgcgagcgaggcgggaaagagggcagtggggagcacgggctgtggtactgagctcggggtgtggacagatctccagggagggcagccagccttccatctctaagctggcccgatctccaaggggaggagcatggcttatcccgggggaaagaaagggcccaacgcattttagggaggcaggtctgaccatccttttgacatcctcaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtgagtcccaggcagggggtacactctgttagagggagcctggactctcctaatcctaagcctagcccctttctccttcctcttgcg

SEQ ID NO: 137765 - DNA, 1184 bp, Homo sapiens
ctgtgaaggtctagggtgaggtggggggctgaccttgcattggggtgggcggtggtggccaggccctagctcagggtgcgtgtatgtgtgtggcaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaatccagcctcagcctctccttccccatcctcacagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggtaggtgcaaagccctcttctctgagtcccctgctggccttctctctacctcccatactcccctcttccagagtaatccttgctgcccgacctcagtcccaaccacatctccccatggattttctgttcgtctcttacactgccttacaccttctgtgtgctctctctctccctctctctttctcttttcctctctctctttctctctatgccccaggccctccccgaccctgcagcttctgccgccgcagcctctctgacccctgttactacaacaaggttgaccgcacagtctaccagttctgcagccccagctgctggaccaagttccaggtactccagaccctggaccagggatagaagggtttggcaacataaagagggttggagaattggggtaggcaggcctgggcagagcaaagaacaa

SEQ ID NO: 137766 - DNA, 1055 bp, Homo sapiens
actaggttctggagcccctaacagcataaggatttcagcagagcgatagaaatgcagggtctaggattgcgtctctgataggggagggacaaccttgacttgagaggctctagtgtctcccctcttctgcctagtggtgtgcctctatcaggctgtgacgagggtcttagggcttatataaccacctgaatccaggggaagctacccatacactgatgcttccttttccttttgctacctttgggtggttgtgtgtgtttttcattggtaaaatataaattcttaatgaaaggtatattacctgtgtttccttaacccccaaggattgggacagaaagctggtgggaaggatagattttttttttttcatggaatagctgcacgtgcacccccccacccttagtacagagcctgaggtaaccctgagaggggccccaagaagccacaggcactcgagttttccctttcagttttgagtaagttcttccccaggaatggaggcgggggttgggccggggagagggtggtgagggcaggctcaacatttaggctgccttctgcttcctttgcaggagatggcctgactgcgaaggcgagtgagaagccgcctgaacgggtgagggggaggggattggaaggagtctggttcccccttagctctgggaaggacagacccttcattttccctcccagatgttgttctgtagagagtgtgtgtaaggagagttaggaggagggagggagcactagtgtctactgcttgttggggagaaagtccaacctccttttcttccctcctcctaagggctgggccaagggtccccactctcccttccccctcccatcttctatccccccccaaaccctgtactagtgttagcctggccagggtgtcagttttcctcccctcccatctttccgaggtacagaagagaagcgagcgcgttaggagagcagaacctccaaaacctgaggttgtagattccactgagagcagtaagtaggatttgaggaagtgtgacctgggagttctgggtgtggaaaaggtccgaaag

SEQ ID NO: 137767 - DNA, 1090 bp, Homo sapiens
tttgaatgagaggaggggatcacgggtagagtgggctccaggaggtagggcgagcagggtgtgacgggggccagactcttgagccaggtaaggggagcaggtgcgtagatctgtgttttttgtgggtgagcgcactcggcccttgggtggaaaggggacgccgcctttcccggggggccggcttcaaagctccagaggctatcttttccttctcaactaacggggccccgggcgggggctcaggcgccgtctctagtggctgcattccactccgcaatttccaggcggccactggactgggagtctcgcgccgggggccggcgctgtctcgcgagccccctcctcgagccagccaatggggttggttgctggcaccgcccgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcaggtaggggtcgggcctgctcaagccgaaccgaacctgcaagcgggatcttgcagtagccgggaggcggtggtgggggggtctaaggagagatcgtagctccaaaatgtcttcctgtaaatgcctgaggttgggggtgggcaacaggagaagggaggactggaggagcaatgggaaagggggacggggctgaggaagtgggcgacctgaaaggtaactggggggaaggggttgcgaagggcagtttgtgggggcgggggaagggccgagggaggacctagcaacgcggggagggggggtggggccagacagggtgggtaaagactggggagctggggggctcctgcagagtggggagggaatagaaactgagatcgcgggggcgggaaaggctcctggtggcgacggccttaggagactctaagggggcgttcagcctgagttgcggggggtaaaaggtaaggggggaagggaatgggagttgcagtcgagtaggggggtgggcgggtagaacgaccgactgcctggccagtgtgggcacggggccagggcgg

SEQ ID NO: 137768 - DNA, 1959 bp, Homo sapiens
aacttaaatttatggatttcgcatcgagtattttattttccagtttgagaaactcttaccataacctgacacgtttctttgtgtttttaacagagaagtcgaggttagagggaactgggaggcactttgctgtctgcaatcgaagttgaggtaggtgtaaggaagggatagggttgccagacaaaacaccgggcacccagttgaattagaatttcacctacacaaccaattatttttaagtatatgttgcatagttttcaattaaatttcaaatttaattgtgggttgtgtattttatttgctaaatctggcaactctagtgggggggccctggttatatttatactgtgtccttgtccaccttccttgttattaaatgaaaagtcctaagaaactcttagagaaggaccttagttcattttacagctttcaggctggccatccaggcagccatctcagtcttgtaaatttataccagatttagatttcagatatgtgtgatgtagtgtttggtcctctacctaaacatttgtttaactgtagcatgcccagtggttagagtctttctcaaccagcaatacgtgttttctctcaaaattcttcatcaggattattagtctcagggacacaagtagacagtaatctttgctgctgatcttcgtgctgtgttctcttttcagaggcccagtatttaggcgacagtgaatttattactctgaagagggttctgcacatatttccaaattatattggtggtcatcagaagtaggtgataggaagaaatacttctcaaggtacttgctacttggtgggcactgttataggtgctttattatgatagtcttcactagtgcattccatcctgggcctctccggggccaggggaagagagatgtttaacacctggaacccaagtaggaaaagatttgattctgatgcccaccttgccccatccccaactatttccagggtggactttagattttgtatgttttaacttcctgcttttatatcttattttttaaaacactattttctttttttgttgtttttttttaaaggtatctcatttgccatgaaactgctacacctgctcatggcgtttaaaatccttacaactttttgagaaaacgacgttgcactatgtggcaagagtcacaggatagattctatttttaagaatttatcctatggaaataattaaatggaaataaagctgaaagccagaagacatttactgcagcgttataataggaaaagccaaaaacaaccacctaaatgtcttatagtagggagtagtttagtaaagtagtacatcctggtgaactttatatagtcattaaaaattacaattatgttgacattagcagaaatgaggaaactctgaatatacaagggtgcattatcagttactgaaatgataatgtatgtctaaataagcaagaatggaaaattgtgggaggaatatttaatcatggatatgtccaaagatttagctatgagcattgattataatggtgaaaaattagaaacgacccaggtgtccaacacaatagggacttggttgacaactgaatgctgtgtccgttaacgtaaaagatttaatgacatgaaagctgtttatgatacatcataaagtggaaaaaacaggttacaaaatagtatttatcatatctcatttcaaatacataaattaatgactagaaggatataccaacatgttaacagtgactatttttagtggcaggtctatggatttttatatttgtatttttatttattttggtttttctaaattttctataatacattttgtaataagtatctgattgtaatttctgtttaaaaatttttaaataaaattttaagttgtaatttctgataccttataacattaatgagaaacaaaattgattaaatgatataaatgtgaaaatttaaatcttggctgaaatgtca

SEQ ID NO: 137769 - DNA, 1378 bp, Homo sapiens
cagcttggttcttagaggtagtcatcagatgactggtagttaaaaataatatagaaaagtctttaaggcttaaatggagaagtctggtactgaatactgtacttttagccttgagcctgtaccagctcattgtaaaaagtctttaagtatatgttcctgtttgagtaccaattgtgtgcctctaagactagaaccaatcccaactttgtttatttccagagattactataaagagttgctctttcctaactcatttcattctgttgcccccagcctgaaagaatgggaactgttaaggttatgaaaattggtgagagattaggaaaatggaacagttactttgttttttgtttttttttttgtttgtttattctcatctgaaggtacgttttgaatgttaaaatctgatgccttgtaacatagggctgcttccttgaattgcttaatttttctctttggccggtaacgcctatatttttctttctcttgcttagtccagcttggcttctggcccgtcgtagagctgttcagatgtcctctgcatactgctttcacattctaaggcacaatttactcataagtggttaggttgccttgggaaatggtgtttacattctctacaacaattaatgtttcctcatttatcagtggttataggtctttgaggatacgactataattctatttccccagtcttttaagtgactgtgtgtcttctctcagatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggtgagcaactgttggcttttgaggcatgtgctctaaaggtggggaagctggagaataatagatgtgcaaaaataggcagtggaaataattctcagatgatgtgttccttgaaagcttgatgaaacagaaccacaaaaatggcacattttaatttttcctcataagttttgtttcaaggataacaagttttttgcctaggatactggagctaaagtatgccctttggaactttttttttttttgagacggagtatcactcttgtggcccaggctggcgtgcagtggcatggtctcggctcactgcaacctccacctcccgggttcaagtgattctcctgcctcagcctcctgagtagctgggattacaggtgtctgtcaccacacccggctaatttttgtatttttggtagagacggggtttcactgttttggccaggctggtctcgagctcctgacctcag

SEQ ID NO: 137770 - DNA, 1050 bp, Homo sapiens
ccaatggtctttgttttctggatgatctgttgtcattgggagaataatacctatgaaattgatgatcacctaagtgttattgacttctagaactacatgtgatttattgcaaggccatcagaagcaaactagggtggccaaagagctgaagcacacagttaagttctttcacttctgtttctttgtatggttgtttagtttttccggggagatattgaactatactgctttagactgttgatggctgctaaggtgttctttgtcaaactgagttattctgattttcctctgcttcctaggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacgtaagtgagggtcattttcagacgtagaccttagattgctaattccttccatggtctggagagttagcctctagtaaccacttttctatgtttaaagacttttggtcagcctggcatggtggctgactcctgtaatcccagcactttgggaggccggggcaggcggatcacctgaggtcaggagttggagaccagcctgaccaacatggtgaaaccctgtctctactaaaaatacaaaaaattagccaaacatggtggcgtgtgcctgtattcccagctacttgggaggctgaggcaggagaatcgcttgaacccaggaggcagaggttgcagcgagctgagatcacgccactgcactccagcctgggcaacagagtgaaactgcctcaaaaaaataaataaaagactgggcaaaacagcggctcacgcctgtaatcccagcaatttgg

SEQ ID NO: 137771 - DNA, 3760 bp, Homo sapiens
caagactccgtctccaaaaaaaaagacttttggtattagcctgggcatggtggctcatgcctgtaataccaacacttcaggaggctgaggcgggtgaatcacgaggtcctgagtttgagaccagcctggccaaggtggtgaaaccccgtctctactaaaaatacaaaaagtagctggacgcggtggtgggcgcctgtgatcccagctactcgggaggctgaggcaggagaatcacttgaacccgggaggcagaggttgcagtgagccgacattgcaccactgcactctagcctgggcgacagaggaagactccgtttccaaaaaaaaagacttttggtactaagctttctcgtatgatttttctgtaatcttatattaatagacgtgggatgacgattatgaaaaataactttttagtcattcggtaggttgtcatgtagtcagtgttaagtctctctttactttgaagatttagagttctgaaaagttgatttgtgcctgcagtatctcttagtgtttaccacaagtcatttctcagagtgtctgtagatgtttaggctgtacttaagtactgcacctacctacttggaatatctttttgagactgtattcagagatctaagtcctgatttcgtcctgtcaaccccagattttcttttttctttttcttttctttttttttttttttttgagacagtctcactctgtagcccgggctagagtggtgcagtggcacaatctcggctcatttcaacctctgtctcccgggtccaagtgattctcctgcctcagcctcccaagtagctgggattacagacgtccgtagagtcagggtttcaccatgttggccaggcttgtcttgaactcctgacctcatgattcacccgcctcgtcctcccaaagtgctgggattacaggcgtgagccaccacccccagcccaaccccaaattttttataatgtcattaggtataaaaacttcagaagcctccaatcctgagccctagctaattcattgtgccagtgacatgtgtagagaagaagcctggtggggtatgatttgattaacactgaactttgttctttcttccagatttcctcgtcctgtgactgtggagcccatggaccagttagatgatgaagagggacttccagagaagctggttataaaaaaccagcaatttcacaagtatgcagtcttgatagatttccctattaggtgtttccttcttaagaaagcttataaagggatatgtaaaagaggcaggtctttgctgcacatgttcactggcagccattatcttggtcctcacaaggaatgcaattcttagctggggtaattctggacaaagttagtaacctaggaaccttgcctatagggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacagggtgagtctaggcctgtaagtcttaaagctgaaaggacaaaatgacatttttaaatgggtttctttgtatcaattaacagaagggcctacatctctgcttttatacttagtttgcgttgattttggtagataaataggcttggagatgtggcagagatactggattctgtggagaaggaaatgataggtataacttcattttggaatctggacaccacaggtggttccaaaggaattagatcctctttgctttctggatctttatttgaagaaagtcattagatctatatgaagacaatgaggaatattcttagtctgttgtttttttagatttgatgaggcgccaagaagaacttcggaggatggaagagctgcacaaccaagaggtgcaaaaacgaaagcaactggagctcaggtaacttttctcgaacactttttccctaacaactctaaaaggtaatgtctcactcctctttcctactgccatgctacctcgtgtatttataaatgtgttggcaaatatttcctggctgcttctcaggttctttctttggattggagatgttttagctgcccatggtcctagaagttacctgctaaaaagaaagcagctgaatgctggtctcatgaggtttctttgggggttgcctcagggctgggcacacttaacagtgagtttcctggtgaactgatagttttcagtaggccagtctccttggttgagtctcctgttaatctgctcaagttctgaaatgcctctgtcttaaatacattggtgactctctgtaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttgtgctcctcagctttctcagtgctgtttggacgtgttatcactctatctacttcccttagtgtgtggtccttgatggattgtggtagaatgcactgctgtcttggactgtcttgagtattttttgtttttcagagagagcaggagattcggatgggtcagatggctatgggaggtaaggacttaggaggttaatggctctgatttccttttttgtttggtcttgggtgaactatgtagcttctgctgcctactttaagggggtgacatatatgtcttacttagcccagaggtcttgttgaattgtttcctttggcatagaaagagactaacaatctttatcccttgtgctgatcacactactctgccttaggtgctatgggcataaacaacagaggtgccatgccccctgctcctgtgccagctggtaccccagctcctccaggacctgccactatgatgccggatggaactttgggattggtaataaaactgcagtgccttaacagtaattctaaatggtggtaggaggagaacaggcattgctttcacagcccctgggggcctacctcagtttgctatagatagcagtctttttttttttggagacagagtttccctcttgttgcccaggctagagtgcaatggcatggtcttggctcactgcaacctccacctcccgggttcaagcgagtctcctgcctcagcctcccgagtagctgggactacaggtgcttgccaccatgcccggctaatttttgtatttttagtagagatggggttacaccatgttggccaggctggtctcgaactcctgacctcaggtgatccaccagcctcggcctcccaattttgtatttttattagagactgagtttgaccacgttggtcaggctgtt

SEQ ID NO: 137772 - DNA, 1056 bp, Homo sapiens
ccactagagttctaaacagacttagtcacccactcctacctaccatcaggagccttgaatagttgaatggaaatagcctccagtggagggactacagatgggtgggaagcttccaacaatggctctgttacagtgttgctctctttttctctttaagaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttc

SEQ ID NO: 137773 - DNA, 2187 bp, Homo sapiens
aataccctttcagtaatcattcaaccaacgcttccatgtctctactctgtcgtaacaaaggctgtgggcagcactttgaccctaataccaaccttcctggtgagtaaagaatcctgacctggccaggggctctgtgtgggtgttggggactggtcagctggggggcagtgtgtttgaggagcggggaaagaaactacctgccctagtttaattggtctgagtgatcttacagcctttgctggcttttttttttttcttcacattatatgggaagaaaccataaatagaaacccggggaagaggtgaaaaatgatacttggtatagttatcttcccttccttgataacttctactgatgtccacagattcctgttgccatcaccctggggtcccaatcttccatgatgcacttaaggtgaggagtaggtgaggggggttagcaagagcatttcccagaagagataatacccaggaagctaagctgatctgggtctcttgttatcagggttggtcctgctgccgaaagcgaactgtagatttctctgagttcttaaacatcaaggtaaattatttatgtacttggattctgcccccaatagaaggattctatccctaatcctatctccttatctatactagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtaaagaggaggaggcccctggacttttcttattttcatgtagcttcctaggagtgattaatgggtcattgaggactgggaactagggaccagggatgtgaggagggccagatgtcagggtttggatggtgtatatcctgtgccttaggggaaatttgtgtctggaaataacgccctttcctctaaggtggtgtgggatgatgggatagatacctgaatcaacagagtagatagcccctcacaaatacatccttagtgtataacacaaaagggattgttgagaatgacttctctttctagaaaagaactttaagataaatctcatatcaagaaaaggatgtattgtattattggcagccaggagacttcccaaattttgtgggaataataagagcaacagaaggaagtcatattaggtccacgattagataaagaggaagaggatatgactcagttctgcagagaaaagtggttaggtttagagcaactgagtagatgggtaagagaagtgctggggatttctctagggttcaggtatttgggatgtccacagagatgaaaattggcaatggggttgctacccaacctctccaactctgcctcactttcaccaggcttctttaattccattaccatcggtgggagtgttggagctagcaatcatagctaatgggtcagaactaaatcaccacccttaacccctaggtcagagttgcctctgaagctgctgccgctaaatatatcccaagccctggaaatggcattggaacagaaggaattagaccaggaacctggggcaggtaggtgggtctttagtaggatcaacttcatagactggaatttagtggaagtggcaattgagtggggggatggataagttcctgactctgtttcccttgcccaggacttgacagtctgatccggactggttccagctgccagaacccaggatgtgatgctgtgagtgagagttttgaggggctcaagcatatggctgagggatgactgggtatagataggctgagtaggatataccttagaatgacctggttctactttatccttcttaggtttaccaaggccctgagagtgatgctactccatgtacctaccacccaggagcaccccgattccatgaggggtgagggaggggactgggtgggctatgaggctatgagacaggtttctcctaatatttggtcataagataatattgggggtgagagaattcagttgaattatcttcctacttcaggatgaagtcttggagctgttgtggcatccagaccctggattttggggcattcttggcacaaccagggtgcagagtcggtagacatgactgggggaagcaggtaagccccagctttcctgaactcttgattagaacccaatctcagag

SEQ ID NO: 137774 - DNA, 1145 bp, Homo sapiens
aaattctcctccctctctgtaccacatagccaagctccctgtcttctccctttagtatagaccaaataagattctgctccttatccctcaacagcccagaggttttgcaatatgaggttgtgttaatctttttgagactctctgtctcttctccacgtgcatcatgagaactccccttcagttaagaatttattcttaccacctgcatttcacatcttctctttagctcccagcatcttgccgccatgattggcaccagacagattccttagtagtggtgactgtatatggccagattccacttcctgcgtttaactgggtgaaggccagtcaaactgaggtgagcaatgatctgatgttggatgggaggatagtcaattgggtgatactacaatctcacaggcagagttgccatttgctgttaacctgtaggctccatagtacccttagaggaaaggagagttattaggtcagggctgtctggccaacctgtggatcatacctctgacctggttatctgtcgtaatgacctattctgaccttctgggtttgttactacccctgtaattcttttctctcagcttcatgtccacattgtctttgatggtaaccgtgtgttccaagcacagatgaagctctggggggtaagtgaagaccaggggacacaagagtgggaggcagatgggtgaaagagcggctagactggaatagagggtgtcttgagggaaggagttgtactaggaaaatggaggttttctcttcatttgctttcattttctctctctctcctactcttcctatttccctctttccctcccctcttccttctcccttttcatctctcatttctttcctctctctcccttattgtcttattcctcccttaccttttttcttaccttattaaaaatttctctctctcatttgtcaccactccaccctgaccccaatgcctttgatttcctcattctctctttcttctgttttcctttgctcctcctcaggtcataaacgtggagcagagctctgtcttcttgatgccatctcgggttgaaatctccctggtcaaggctgacccaggatcctgggcccagctggagcaccctgatgcactagctaagaaggctagggcaggggttgtgtta

SEQ ID NO: 137775 - DNA, 3251 bp, Homo sapiens
aatggtttagaaaaacaaaaatcctagcaaaatgttaaccattgtgagtctaggtgaggggtcagctgttcattttactaaactttcacattttccgaaataaaacgttgggggaacaagtattttttttgaggcgggctggagtgcagtggcccgatcacaggtcactgcagactccaactcctggctcccacctcagaccccccaacagctgggactacaggcactggccaccacatctggctaatttttttgattttgtgtatggatggagtctcgctttcttgtccaggctggcctcatactcgtgggctcaagcgatcctcccacctcggcctctcaaagtgctggaattacaggcgtaagccaccgcgtccggtcaaaaaatcaatttctagggaaaaatgtcaactcaaaacaagtaacctgcatagctcgggaatgcctgtataatttacgtcaagtctctccttgggacggaccggtgaaattgcacgcagcacaaagaccggctcttacccttacttccgggtattgtggtacaggaacccgaggttgcctgcgcgtaagccacgtgactcgagcagctccttctgattggaggaagagccactgctctaattcggtgccgtgagaaagctcgcgcgcggagcagtgggagcgggcgggactgaatattttctttgaccaaccgctttccacatatccatcctcctgatcccgtagcgtcgaatcaaaagccgttagtaaagtagttacttctttctcttaggatagccggtctttccgggttttcccccccttccccctcccctctccccacttccccctccctttcccctctgttttgagcttccggtagaggctggtagggtaagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgtgagggggtgggcgtgggggtagggctcggggggtggggctaagcagaggaaggaggtgcggggaggaaaggagagggtgctcaggcagcgagaacagggcgcagctaacgccggggaggaggatcccgtcctcatgggtgcgggagcaacgtggcgtgggagtgatcgttctgggggagagtgggcagaagagagcgcgaggcgagcccggggccaggggcgcagggaatagtggctttggagctagcgctctgccgaccagacagtaggacacatgctggtttcgcctactgagatggcttcccacccgtaacctgcttggagattcttgacactgcctgcccctctgacatcgctgccctgagatggctctatagagccagaggactggacaggacctgcctcccgctcgtttggttccggcctcaggcttaggacaatggggtgttcctagcacccgagcgggcctcctggtcacagtgcgccttttaggtggctctcccagcgtcttcactgactttcgtgaaatagtgtcctgcgccctagtgaaactaccctgccttcacttaggcccgttttcttgaggagtgaagctgtcggccgctgtggcccctcctgtgccgcaggcgcatgcgaaacagggaccgaacgagccccgcctcgacgcctccaatcccactgatccccctgcctcggccctcgttccgagaacgaccgttccattcattcagtcttggcagtagttatttgattcgtcttctcttgtagtatactttaaagtgtgggcgatgcagttggctgtggtgctttaataaagatctgatcgatgcggagtttggtagatgtatattacagttctcgaacgtgttgcttgttttggcacactgcacagtcatttttcatgtggatttgtgactttgtcgtggaccagggaaataagtcctgtggtgtgggagtcgtaggtttagttgttatcttcgactcgtgctgtccctttttcaggaatgtaagaagcacttggcaggcttgggggctttggggctgggcagcctgatcactgaactcacggcaaatgaagaattgaccgggactgacggtgccttggtaaatgatgaaggtgaagtctgggttgtggggagtaggcgggggaggaggctagccacctactatgtatgtacttttttgtgtgtgtaagacggagtttcgctctgtctccgaggttggagtgcagtggggcgatctgggctgactgcagcctccgccacccgggttcaagcatttctcctgtctcagcctcctgagtagctgggactacaggcacgcaccaccacgcccggctaatttttgtatttttagtagagacagggtttcatcatattggtcagactggtcttgaactcctggcctgaggtgatccgtctggcttggccttccaaagtgctgggattacaggcgtgagccaccgcatccagcctgtacatgtacttttaaatgggaattatctgagggagtgagggtcgcttactgttgttgcgattctccctgcttttttcatagggtgggttaggagtacagaagatgctgtggactattcagacatcaatgaggtggcagaagatgaaagccgaagataccagcagacgatggggagcttgcagcccctttgccactcaggtgattctttggtgtattggcttgaacattccagtgcattatcctgctgtatagtccagtttgggctctggtttctatacccgctgtctgccattgtttctgctctctatgcctttgctttggctcctccactccctttgtcaggtcagttccaagtagctgctatctttttttgtgttctggccagtcttaaccgtattcatgtggttattcctcacactgttcagtcatgaattcttagttaatgacaagtagctttcttgtcacctggtatttgaatacctacagggtttgtgagatacacttcaaagttggaaactatgaaacaaattcagtttttgcccttaaggaatggatagttcaagaaggatacaacgtcatacataagcaatgaactaaggcaggacgtggtggctcaccagattacctgaggtcgggagcttgagacagcctgaccaatatggagaaa

SEQ ID NO: 137776 - DNA, 1061 bp, Homo sapiens
attctcctgcctgagcctcccaagtagctgggactacaggggcccgccaccaagcccggctatttttttgtatttttagtagagacagggtttcaccgtgttagccaggatggtctcgatctcctgacctcgtgatccgcctgcctcggcttcccaaagtgctgggattacaggcgtgagccaccacgcccggccacatctggccaatttttttgtatttttagtagagaaggggtttcaccatgttggccagattggtttcgaactccttacctcaagtgaccctgctcccctcggtctccataagtgttaggattacaggtgtgagccaccgcaccctgcctaaaacaatgaacttgatacctgcttgcaaatatgtttttttcctctctggtatagggtgctacattgtagaatcaaaacatcagacttagaaggtagagtcagtgagtggaaggagtcttaggaattatttattcgtaatctctagtagaaaaggaaaacttgaactttagagaactttataataaaatgtgggattttatcaaaagtaatacaattagctagtagtagactgactaatttagctcagttcgttagacattgtttgagcacttgttatgtactctaaactgataggcagtgtgtttcttttttttttttttttttgagacggagtctcgctctattgcccaggctggagtgcagtggtgcaatcttggctcactgcaagctctgcctcccaggttcatgccattctcttgcctcagcctcccgagtagctgggactacaggcgcccaccaccacgcctggctaattttttttttttttgtatttttagtagagatggggtttcactgtgttagccaggatggtctcgatatcctgacctcgtgatccacccgcctcggcctcccaaagtgctgggattacaggcatgagccaccgtgcctggcctaggcagtgtgtttcaaagataatgaagtccgctgggtgtggtggctcaggcctgtaaacccagcactttggggggcccaggtgggcagatcacgtgaggcca

SEQ ID NO: 137777 - DNA, 1023 bp, Homo sapiens
tcaccagggctggagtgcagtggtgtgatctcagctcactgcaacttccacctaccgggttcaagtgattcttccacctcagcctccccagtagctgggactacaggcatgtgccaccactcccggctaattttttttgtatttttagtagagatgaggtttcgccatcttggccaggctggtctcgaactcctgacctcaggtaatccgcccacctttgcctcccaaagtgttgggattacaggtgtgagccaccccgcctggcctgcttgaaacttttatgtgaagttgctcgttatttattcatcgtccacctcttcgaactagatttcaggcttctgataaatgtagataaaaccttggtaaatacttgaacttagttttttcgggacagcttatggatttgagtgctacttatatgaaaagaattaactgtgttgcatatacaaaaagtaacccacgaaaaatagaagatataagccctgcctttaaggatattgttatcttttggggaagatgatgtgaacaaatgcagaacaattattcatagtaagacaaaccacctatgagatcatgtttctgtatatagagtgttacatttagttttgatgggctgcaagaataggtaagtcaatagctgtcatttttgggcaccctgactggggggacatggtggcagttattttcagtagaagttataatttccaggtttgtgtttgttgtcttgactagggatggtaaggaaaaggctgggagtttccctaggtgagttttatgagctaacttcctataaaaggaggatgctacatttgacagaatctcagtactctgggatgctcatttctaagttctcttgtcctctaggggtgccttcacctatacccttagttttttccttccttggcattggctcctttgcatggcttggtttacaagggtgcttctttggaataattggaagtgggtgtagattgctaataaagctttcatggaggtgaattttgagtaaaattttgaaagtga

SEQ ID NO: 137778 - DNA, 4148 bp, Homo sapiens
cactgctccctgccgaacccgggaatcttaaagagtttcttaagtaatttatgatacaactgatctgtatactggtatttggaaactacttgtttagatggctttattttaaatgaagtggttaaattaggaaggtgccctggaatgttgataaatcagatagtgtcaactaccagatattcagagatttcaaaggctagtagagtcttcagtgtttatcttacctattcctataacagtaactgtcctaggcttgaaaactggggaagagcagtgtttttgacctcctgtattttgaggcttgtattaacctaaattcttcctgttggagttttaagccatttcttttaacagtctgctaaatgtcagctgttaactttgttttatagatcttatttatgccaaagaaccttaatgttgtcccgtgggcttaaaaaaattctccagctcatgagtctctgaactaggactacctgagtggtataaagtattacatagttttgctattggtcacaacattggttacaatattggttacttatcagaaagtagggccaggtgtggtggctcacacctgtaatccgagcactttgggaggtggaggcagatgatttgaggtcaggagttcaagaccagactggccaagatggtgaaaccccgtctctactaaaaatgcaaaaatttagccagctgtcgtggcgcatgactgtaatcccagctactcaggaggttgaggcaggagaatcacttgaacccgagagagagaggtttcagtgagctaagatctcaccactgcactccagcctgtgcgacagagcaagactctgtctcaaaaaaaaaaaaacaacaaaaaatcggaaagtagtaaatgtagtaatagtgtttgttttctcatcacaaccctagggtaccaggtacgtggtgagttgggggacgatgggagataacgagttagaatgagttttctgggttgcatactagtattatgatttgggtgcttgggcctatatctcctggcattgagccatgtgtatagcctaaagtgggtgtttgcggaattcgaggaaatatgttcacagttacatgccaaaggggtttctcttccttgttgcagtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtacattctgtggagaatgctcagattgcaaaccactgacctcttccaaataatgagttttgttgttaagatgctgagtatggaatggggtttccttactcagtgacatattattggctacataagagctcttcacactgtattaggtcttttttttaaagttgtatgtattgatagtaaatgtgatttatgctgttctcattggaaatttctctgttatcttaaaagaactagcccaaattattaaggaacgcttctttactttcttagacgttacaagtctgaatgcgacactcctttgtttctcccccacatttgaagagatctctcaagggagttttcaggcccagatgctgctgttttcccatctgactttgagtctgtgtcatagtaatgtattctgtgttctaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggtgagcaacactggtatgtaagaaaggaatcaatgtactcaggtcctattacttttactaactttactctttaattggggagatactgggtggtagggtttctttggtgggagattgaggtgtctcagccttttatttggtatggtgtatcaccctggtagctaggtcctattctaaggattctgtttgtgaaatgaatgctgtgccagactaggagtgggaagaggcaaatattcctccgttatcaggtggttgtttcaagtaaaggaccacttacaatgtgtctgatgtatctttaatgtggaatttggagtggaaaccttgaccagtgaccaatcaaggatgtgttttttcttccctacttacacaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggtgtgcttctgtgccagctgtgtctagcagatactgcccttaatcttagtcaccataagtgggctcagctgtgatttttttttttttttttttttttcggtgagacagagtttcgctcttgttgcccaggatggagtgcaatggtgcagtctcggctcactgcaacctccgcctccccagttcaagcggttcttctgcctcagcctctggagtggctaggattacaggcgtgcaccacgatgtctgactaatttttgtatttttagtagagatggggtttctccatgttggtcaggcaggtctcgaactcccgacctcaggtgatcacccgcctcagcctcccaaagtgctgggattacaggtgtgagccaccacgcccggctggctgtgatgttctgagctgccaagagatagtgaaatttttaggatctgaggcctaattctagtccctgtaatttttattttatttttatgctcaacctggaggaagatagtccatgtaattttttgccctgttaagaagctaggccagactcaggtttcttaaaaacatgtgataaagatcttttttttttttttttttttgagacggagtcttgcttgctctgttgcctgggccggagtgtagtggcgcaatctcagctcactgcaatctctccctcctgggctcaggcgattctcctgcctcagcctcccgggtagctgggattacaggcatgcgccaccatgcccatctaattttgtatttttagtagcgatggggtttctccatgttggtcaggctggtctcgaactcccgaccttaggtgatctacctgcctcagcctcccaaagtgctgggattacaggcatgagccaccacgcctggcctgaagttaaagatctttctgaactataacagtactttatagtatatttttgttcccaagtccctttgtatttagaattctag

SEQ ID NO: 137779 - DNA, 1954 bp, Homo sapiens
atttattttttgagacagaatttcactcttgttgcccaggttggagtgcaatggcacgatctcagctcactgcaatctctgcctcctgggctcaggtgattctcctgcctcagcctcctgagtagctgggattacaggcatgtgccaccacacccagctaatttttgtattttttgtaaagatggggcttctcaatgttggtcaggttggtcttgaactcctgacctgaagtgatccacctgcctcggcctcccaaaatgctgtgattacaggtgtgagccaccgtgctgagcctgcaacattattttaaagtgagaaatacactgtgtaggttccttttcagtggacacatgaataactccactaactcgctctactaacatgagtaactctttttatctttgccagaatcttgattgaaaggggcataaatgttttctctgttactatttcctccttgcactttgactaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttgggtatattactggcagaggccagtgtttcttctcctttgaaaacttgctgttaatgtcaacgggcaggaggaaatcagaagggttggagatgattaggactagaaacctgtaggtagcggcttgagagagcgaagttttggctgttagtttatattatttgtgtatatgcttagggaacactcacgtaggaatgttggaaagttgcaactttgagatgtcaagagcatagtttgttccgttagtgaatcatggactcgaaacttctaggtagcagtttgagagagcaaaattgtggcagttagtttttattatttgtgtattccctagggaaaactcatgtaggactgtcggaaagtagtacctttgagatgtcaagcgtgtagttcacttagtgaatcatgtactagaagtgatttgggatgggatgaaaagatacaggtgtagttcagttagtaaatcgtggactagaagttacctgggggggggtgggatgaaaggtctagttaagaccttcactggaacatccgtcaccttaaagaagaaaactggatacttgtctgtaggaaaggtgaatcttcagggagagcaactcaagtgatttttgttttattctcagaaattcctgatgagaaggaagaggccacctctaactccccctccaaggagagtaagaaggaatcatctctgaagaagagtcgaattctcttagggaaaacaggagtcatcaaggaggaaccacagcaggtgtgtgaagaaaaaaggggcttggtgtttagaagaacaaagaaaggtaatagagaaggatagtctgaccgagatttgtttgattatctatcattagaacatgtctcagccagaagtgaaagatccatggaatctctccaatgatgagtattattatcccaagcaacagggtcttcgaggcacctttggagggaatattatccaggtacaaatagtgtcttttctgtgatagaggagaaccccatggctttgttctgacggaggatatgggaaaatcttgcttaggatggaattagctaattttaacccttctatttcctgttttagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaaggtataattgaattctggttagaaaacagctataaaggatattggggtataaattaaggga

SEQ ID NO: 137780 - DNA, 1021 bp, Homo sapiens
tgcctcagcctcctgagtagctggactacaggcgtgtgccaccacacccagctaatttttgtatttttagtagagacagggtttcatcatgttggccaggatggtctcgatctcttaacctcgtgatctgcccgtcttggccttccaaagtgctgagatacaggtatgagccaccatgcccggccaatcctaaactttttgagcactatgatgatactcaaatgctcattggagcattttggatttccagatttgggatgcccaactggtaagtataatgcaactattccaaaatccgaaacacttctggtcacaagcattttggatgagggatactcaacctgtattagtaaagtgctatggtcatattgtgtaggattattgatatattctaaataactgggtcttctgtgttccttatagaaacctggaaaagatcctggagcaccagattgtaaatatggggaaactgtttactgccatacatctcctttcctgggttctctccatcctggccaattgctgcaagtgaggaattctttcctgtttttactgttaactaaggaaattgataaatgaggaaccagtcagctcagaaagaactattataattctagttgattgagatgctttaattttaagtacaaagaaaataagtataatccaaaaatgttttaaagaaatctttttcttaaaactggctgtgaattgtgttattctcaggctaaatgtaaaataggtttttaaaaatacacactggtaagctcagtaacatctgggaagcataaggaagtcaacctaggatgaatttactataaatttactataatttatgaatatttaatttttgtgtataaaattgataacattttgatcacattagctgtggttattgtgaatattgaaccacacctgaactgtgccatctacagtccccagccatagtgaaatgctttttttttccctcctttgttctaatgggtgtaaagaggctctcttataacagcttttatatattcaa

SEQ ID NO: 137781 - DNA, 2478 bp, Homo sapiens
taattagtttaataatttattcaacaaatgttgctctcacacgttgtgtgttgggctacactggggtctagggtagtagtatagtacttggtacattatgaagtgattttcatatgtaatcttcatagcagtcctgtgaggtataggcatttttaagtatctctgttttgtagatgaggaaaactaaacttagacatgttaaatagcttaaatagacatgttaaatcatagaggtaatggcagagctagcatcatctgaattcacatcctgtattttctcccctactgactctgaaagatagtggatgaaaaattgtttagtcacatttgataatctatattttaatttatttgtattactggatagaccttagatggcgtaattaagatggagagcaataagcttggtatttctttctcagcagttgactgaatttcctagggctactctgtatataatttttgtgtttttacttttgttaggcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtaagaatgggaggatagggaggggattgggttgtatacagaaagggtatgttggggccgggcatggcggctcatggctgtaatcccagcactttgggaggccgcggtgaatggatcacttgaggtcaggagttcgagaccagcctgaccatcatggtgaaaccctgtctctactaaaaatacaaaaattagctgggcgtggtggctcacgcctgtgatcccagcactttggaaggccgaggtgggcggatcacctgaggttgggagtttgagaccagcctgaccaacatggagaaaccccgtctctactaaaaatacaaaattagccaggcgtggtggcacatgcctgtaatcccagctactcaggaggctgaggcaggagaatcgcttgaacctaggaggcggaggttgcagtgagccgagatcgcaccactgcactccagcctgggcaacaagagtgaaactcagtctcaaaaaaaaaaaaaaaatttagccaggcatggtggcgcacgcctatggtcccagctactctggaggctgaggcaggaaaatcactggagcccgggaggcagaggttgcagtgagctgagatcaaggcactgcactctactctgggtgacagagcgagactccgtctcagaaaaagtaggctgtgtgggtttgggagcacatcgggaaagatgaaaatacattagagcttagcaaaggaagaggccctagtgaggacttttatccttttctttgccaaataaaatacacttggtttgttgggcaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacaggtcgtctgttgtgactagttatttgtctgcctttttccaagaaaagaattttgatggctttgagttaaaggataagcatatagttaataaaatagaaattgatggctgttgaaaggaggtagcagatcttctaacactctggttgcttttttgaatttggctgccaggaagtttaatgtgattgttggatatcttctatgagttgtaggaaacttagcagctggggttttcttggccagtcatgccaactgtggctaggcctgttacagttttggtttgctgtccctgttgctgtcaataaatatcagggcctttggaattcagaatggtctcattctctatgtatatgtcttttccagggatggactcaaactggtgggtgcttaagtctgattttcgtttaccaacggaagaagagatcagagctatggtgtcaccagagcagtgctgtgcttattatagcatgatagctgcagagcaacgactgaaggtgaacaccttcctcttagacaccacttatgcctgtggttttttgtttttttttttcttccccccagagagatgagagagaagattctttctctgactggcttagggaggatggtttactagattattaccaattactaaaaagttcaatttgtataaagtacttctacgtacatcagttctggagaaaaactatagtgtagctaagtatcagtgggaaggcataatgaggaactttgggcatattgttttgctttgaaaatggtgactgggtgactttaatctcttctttgcaagataagcatataagcagggaaagtacttgtcagcctctcaggtaggcagagatgatgatggtgctgaatgtgtggtttagagaagcacagaa

SEQ ID NO: 137782 - DNA, 1081 bp, Homo sapiens
ggactataggtgtgcgccaccacgcctggctaatttttgtacttttagtagagatggggtttcaccatgttggccaggctggtcttgaactcctggcctcaagagatctgcccgcctcagcctcccagagtgttgggattacaggtgtgagtcaccacacctggcctcatgtactcctgactggtctgtgtgggcaggcacattcaccccttggcttaattctttaagaatcttgcaggggttggtaaacactattcagggtcccaggagaggacagacctttttgaccaaaccagtggcagaaatagaatggactttggtttagtgtcactggaaaaggggccaatgctttgaaagcaagcatgtcaagtatttcgagaaaataggtttcattctaaaacagctgtttgagcaattggacaatcaaatgtagtcattagtctaattttgagcatcatgagggtgagggaaacactgtccttaagaatgtttattgaagcccaagggataaggggctgaagggataccactgttctttatttttctccttatcctgcctgagctcttgacctctatttaatatcatgttgtaagtattgtaccataggatagaagagaactgagtactaggtagctatatttaactgttgatttttgtggacagtttaagagagcatgaacccacagaaattaaaaattagaaaaaaagaacatgaaaatagtttgtaattattctactcttgtagatattggctagacatagaacaaatgtttcccactgccctgagaatctttttctttatctcaggttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggtgagattgtgtttatttctagaatgaaaaagtcaagggagaaagaaatgggtgagtggaggacttggaatgtagttaaggtagcagaatgacttagatgcctacttaaaaggaattcaggtt

SEQ ID NO: 137783 - DNA, 1856 bp, Homo sapiens
gaggtaggatgataaagaaccgcagccagtgaagaagacagtgacaggaacagatgcagaccttcgtcgcctttccctgaaaaatgccaagcaacttctacgtaaatttggtgtgcctgaggaagaggtgagtgtggaagtggaaaatttagagtatactaggggctttgtatagagttggaattgctaggaggcagatgtaaagaactatctggggaactttattgtagggtatagtaagctaagtcttagatattgttttaggagttatctttctatgtaatctgctttggggtgatttttcttttttggtctaactgtgtacattggcttgtcctttgaaatccctgaatgatttgtgtgtgtgtgtgtgtgtgtgtgtgtgtgtgtgtgtgtgtatatttatatttgtgtgtggctatttgtctcgtagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaagtgggtcgttttagtgctgcagaaaatccaagctggaaagggggaggagttccaggcactatttcataataaagaggaggtcacctaaaagtttgactacctaggtagtcagatatctgacatgtcagggtagtatatgtttgtaatcccaccaccagattacctattcccttcaacccaacttggcaaaatttttgaacagaaggaaacgctagtcttgtgttctaggttccatgacaacttttatggcctacttgggcctaacaaatagcacaatggtagcaggtgacaggtagggcttttttctaaaggtttagttgtgagaggatgttaatacactattaaaaatgaccagtgtgctgatttatttatcaagttgtctccaggaattctgaaagagttactacaatttttcaaacttatcttgttgaccaaatgtctaggaaaactttgtaaagcttttctgttaagggccccatgtcttagtggattttgagtatgcctttttaaggttgatttcccaattttttacttttgcctgcaaccatatttctttagttctttctgcacattgctttttctctttttagggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactgggtgaggatcttggcttcacagacagataaaaaagagaagggttaaaaaaggagcctacgtaactgcagactgtaattgagggagatctggaggcagaagatgtaagggatgcatgtagaaaagtctgtgaatgaagtagaaagctttttacaaactggactctaggattgtctgtggaggaccaattgcagagatgatgccactccactaactgcctctgtatcaggtgcctggccaagcctgggctattagtgctgtacttcaaatgagctttttgtgcatttatcctagagggtaagagtttttaatacagaatttgtaaatgaatttagggagttatctttgaaacttctgaaattacatgtaaaatatgtaaatgtgcattttattatttttttattttggagacagggtttcattctgtcacccaggctggagtgcactggtgtgatcttagcttactgcagcccccgcctcc

SEQ ID NO: 137784 - DNA, 1066 bp, Homo sapiens
aaaattgtagaaattgagggtgggaataataaagacctgaattgggttgggatatggagggcattaaggatgaaaatcaaggcaaccttaagatttcactctgggattactagaaagatgttggtaccattgattaaagtagtgaatttcaaggtctgacatgctggctcatgcctgtaatgctagcactttgggaggtcgaagtgagaggatcatatgagccccggagtttgagaccagcctgggcaacatggtgaaaccctgtttctacagaaaatacaaaaattagatgtggtggcaggcacctataattccagctactcgggaggctgaggtgggaggatcgcttgagcctgggaggcagaggttgcagtgagctgagattgcgccactgcattccagcctgggtgacagggtgagaccctgtctcaaaagaagttaggaagggaatgtgtaatatgtggagtttgaggtccctttgacacccttgaagtatacatgttaaagaggcagttgaaaacttggttgttgatactgcgagagaggataaaggctgatgatgaagatttatatggcttctcagtcacagtagtcttccctttgtttcctcttttctgtaaaagttttgtgtaatttcattgttttgggtcctttgtaaaaatgtgatatagcccttccaccaatgtggtcatctatgttttctagtatagtcctggaacacagtatctgtatcatttgggaattagaaatgtggaatctcaggcctcactccacatctactaaattagaacctacatttgcagccgggtgtggtggctcacacctgtaatcccagcactttgggaggctgaggcaggcggatcacctgaggtcaggagtttaaaaccatcttggccaacatggtgaaaccccatttgtacaaaaattagccgggcatgatggtgggtgcctgtaatcccagctacttgtgaggctgaggcaggagaatcgcttgaacccgggaagcagaggttgcagtgagctgagagtacgccattgaactttaccctgggcgacagagtgaaac

SEQ ID NO: 137785 - DNA, 1050 bp, Homo sapiens
catatttaatattttcatagtttacaacttaaattgggagtggaaatcttctctttattcttcttacctgatttttaaagcaatgtttagtctctggatttcattttttttctatgtgtcatttccatacatgcagatttgtctagtggcttctggttgatcagtgcataacaattctattagagcaaaagttctgaagctgactttgtttttcccatcttgtatgtacagttgagctttgaacaacataggtttgaactgcatggttccacttatgcgtggatcgtggtacgtggagcctgtgtatatggagggctggctttttgtatatatgggcttcactatgtgtggattttggtatacttgggggtcctggaaccaatcccctgcatatactgagggatgactttatttcttacctgcttatctctgatatgtgtttcagcctacttacctctgacgtgtttgatacttttccttttgcagctgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagaggtaagagataccaggcaggaagtgctatgggacagatttatttgaggttggttatattggtggctggcaggggtagatgtgatgtgttctctgaagtggaactgaaggaacaggaattttgatggcgtttcctcagttattgttgccagtaatgaaaattatagcgctgattaggttgtaccacttgttttggagcatgctgcctaacttctgagtctgtttccttagttacaaaataaaaccacctttaccaggatagttaagaagataaaatgagacagactacaaagcatacagtacagtgcctgacatatagtagatgtcagttatctcttcttgttctacttctaga

SEQ ID NO: 137786 - DNA, 1009 bp, Homo sapiens
tgtgcgtggtggtgggcttctgtaatcccagctacttgggaggctgaggcaggagaatcacttgaacctgggaggtggaggttgcagtgagctgacattgcgccattgcactccagcctgggtaacgagcgaactacatctcaaaaaaaaaaaaaaaaaaaagagaatgttggaactagaaggattcttaaaattctttagtctggtttccttatcttcccaataggaaactgaggtaaaattgtgacttgcctagttatttattaacttggagagcctatgagggcttgcctgatctgaaccttagaaggtggatgtttggcctttggtttggctttttcctcgctaggctcgtgcttaggtaccttggacttttttttaattatagttgctttttttccccctgggaactagaaataggggctgtatctaactaaagtgttttgattttagtgcggatgaggttcgcagaaaatctctggttctcaagtttcctaaacagcagcttcctccaaagaagaaacggcgagttggaaccactgttcactgtgactatttgaatgtgagtatgtgcattgcttccttctgattaggtaggttatcattgattccccagccctgtatgccacagctctgacagccttagattctccagttgccttgccctgagaattatttgtactgttcattataagatttctaaaatatgtttgtctagttagagaaagtggatttttttttttttttttgagacggaatctcactctgtcgcccaggctgaagtgcagtggcacagtctcggctcactgcaacctccacctcccaggttcaagcaattctcctgccccagcctcccaagtagctgggattacaggtgcacaccaccacacccagctaatttttgtatttttagtagagatggggttttgccttattgaccaggctggtcttgaactcctgacctcaggtaatccactcgctttggcctcccaaagtgctgggattacag

SEQ ID NO: 137787 - DNA, 1062 bp, Homo sapiens
ggacagaatgtggattttttttggtctgaggaagcattctgatttcacatttctccttagagacctcataagtccatccaccggcgccgcacagaccctatggtgacgctgtcgtccatcttggagtctatcatcaatgacatgagagatcttccaaatgtgagttcattgcattggatatctatagtagggatgtcaaggccttttgttctgtctgtgatttccaatagagggcagtaatctgtagatttaggtaactggaatgcctaatttttagggagttagttttttttgtttgtttgtttttttaagcagtttagtagaggaaacagacgtgctccatctagaaagattcctttcagtgttgatagccaggtagataggtaagatgtgaaagtcttcaggaattggctctggcaactgttatttgctgatgtatggttctggcccttgtttgcagacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatggtaagaatcaaatgttccgtgattgcaaaggtcactgttcagatccttattccttactggccctaaattcagactagattggactgagaggactacagtgtatttgtgcattcatttgtgggtatgaaaatcaggtaatgtacattttcagtcatttaataaatatcacttctttttttttaaggagggggttggagtctctgtcatccaggctggagtgcagtggcgcaatcttggctcactgcaacctccgcctctcggttcaagcgattctcctgcctcagcctcccgagtagctgggattacaggcatgcgccaccatgcctggctaatttttgtatttttagtagagactgggtttcaccatgttggtcaggcttgtctctaactcctgacttcgtcatccacccgcctcagcctccca

SEQ ID NO: 137788 - DNA, 1040 bp, Homo sapiens
aatcttaaactttttgaatgcctgcttgatgctctaaggaaatcctcattggagcatttggatttctaattttcggattagggatgttcacatatttgcagatattccaaaatatttcagattcttaaaaaacctgaaatctgaaacacttgcggtcccaagcatttcagataagggatactcagtctgtacctaggagccgaattgctgagtccacatggtaactcttatgtttaattaactttttgaggaactgccaaactgtttgccagagcagctgcaccattttgtaatcccaccagcagtgtataagggttccagtttcttcatatccttatcaacacttgttattgtctatctttttccttctaaccatcctagtgggtgtaaagtggtatttcattgtaattttgatttgcatttccctattgactaattatgctgaaaatttttgcatatggttagaaataccattcttgaacttttgtgcatttgccactattgaccactttttcctccttgatactgtcttctcccttttccagaaatactttctcgaatcatttccttgccttttcattctcattacttcagccataatatatctgttaacatcactatctccagccccatacctctcttcagggctccatacctgtgcttctagttgtctgccagacatgtccatttttcattgcccaactggcaacttattgtctgattgtctatctagttgtacatcctagaaatcatagtcataatttattccatcttcacttccccatactcatagataaccaagtcccataaattggaaattctaagttgccaatggaaaaacaaataacaaagatactggtctggggttaggagagtgttcgcagtcatcatactcctcttggccagcagtgtcccacgtgttcaggctaacgatttgcccatccacggatgtctggacgctataattgtcaaagacagtggggggatatactcctcaggaaagacatttgttgtataactgatgaggaggcaggttttac

SEQ ID NO: 137789 - DNA, 1202 bp, Homo sapiens
ctggtatgtgattttaaatattgacctttttgctatatgggtacattatcttttttttttaagagtacattatcattgaaatcaaagaggccaggaatctttggatgtagggaggtttttgcttcctgttgttgacattcagtatatgaatgctcctgaatagccctgtagagagaggatgctagcgaatgtgaggcttttgatttagaggtgcttctaagcaaatgatgctttgataattagacaccattggttgtcttttatttcatttttatattgttacagtgatcctccccaggaattctcaacagagtttccttttgtactataggaatgtgttctatatgtgtaatgctataaaacttctcgttgggactagggaataaggaattttaattatgactatacagcaagtgtttttatcctatcatggcatagaaatccttaaaggaatctatgaaccccttacattataaacagaagttttgtatgattatgtgtttttctaggaaaagagtccatagctttttttaggaatatttgtaacccaacaaaggtggtgaaattctcgtatgaagagtggtttccatttaatttcttatgctttctatttactagtcttggccatttcatcacccagttaataagaaatttgttccagattattacaaagtgattgtcaatccaatggatttagagaccatacgtaaggtgagtgagtgatttgatctaaatgcctttttgtaatcaagtgactgtgtgtgtgtgtatctgagtgcctgattcttttcatcacagaacatctccaagcacaagtatcagagtcgggagagctttctggatgatgtaaaccttattctggccaacagtgttaagtataatggtgggtatttctcattattttctttccatgaatccgtccatcttctatccatctaacattacttagcattattaaaaaatttttttttgagacaggatcttgctctcttacccaggctggatgctgtggtgtgatcatagttcactgaaccaggcacacgccaccgtgccaggctcttttttttttttttttttttttttttggtagagacagggttttactattttgcccaggctgagctcaagcaatcctcccacctcggcttcccaaaatgctgggattacaggtgtgagccaacacgcctaaccagtattattaa

SEQ ID NO: 137790 - DNA, 1017 bp, Homo sapiens
gaataacatatgccaggccctgtgctagctgcttaatctactgataagaaagacagtcactgtcctcaagtaattcacaatccagttggcagaaagagacaattaaaatgcagcttggaaccaggcatggtggctcatacctgtaatctcaacactttggtaggctgaggtgggaggattgcttgaggccaggagtttgagaccagcctgggcacacatagcaagaccttccttgtctgtataaaaaacttataaacaaaagcttagctaggtgtggtggtgagtgcctgaagtcttaagatatttgggaggctaaggcaagaggatcacttgaactcaggatttcaagactgcagtgagctatgatcacgcccctgcactacatcctgggcaacagcaagaccctgtctctataaataaataaaataaataagtaaagtgcagcttgacaagagctataatagaagtatgtgcagattgcatcagacgagagcaaggaataacctgagagttagggaaggcttcataaacgagctaatatagttcagtttttaatgactcaatttttaaacattgagtacttacatgcgctggcactgatagatgttactaatatcaaattagatatggtctctgctccaagttagtttagttggagaaacagaaaagaaaaattatagtacttaaattttattactataagcatgcacagagtgtcacaggacagtatatctaaattagagtggggctgggtgcggtagctcacacctgtgatcctagtaccttgggaggccaaggcgggcggatcatttgagctcaggagtgcaagaccagcctgggcaacatagtgagaccccatctcagaaaaaaaaaaaaagtggggttagaggaagctttctggaagagggttttctttcttctttttcttttttgtaaatagagatgggggtcttgctgtgttgcccagtctggtctggaactccagggctcaagccatcctcccatcttggcctccca

SEQ ID NO: 137791 - DNA, 1691 bp, Homo sapiens
ttgaatttctagtttagattctgagtgagattatgttactctggtttaagagactgaacctcttaatcttggaaactaaacatcctaatttacatttgatcctcattctacataaggtaaggagcctagctatattgtgaaagattagattcacttctctttaattttcacttgttttggatctagtttgaagataaatatctaagaattgcaaagtcagagctcatctctttgggatctggactatgtgtagttgcatttagtaattctaatttctttaggaatttagtatgcagatttttctttttatatctggcactgatctttttttttaaactttctacttctactgagcttttattttttaattttaatggttcacattggaacaaatgcatatcctcacaccatccactgtcaagataataatttatgctgttttgacagagtactcattttcttagggaggaattatttttagtatttgtggaagagttctcaagggaaacatgagcctaggagtgatcacaaatcccctcttctccttggtgcccaggggtgcttgccaacttgactggtgtttttctctgaatcttttcagaaagttagcagcaataggttgggcgtggtggctcacgcctgtaatcccagcactttgggaggccgaggcaggtagatcactggaggtcaggagttcgagaccagcctggccaacatcgtgaaactctgtctctgctaaaaaattagatgggtgtggtggtgcacacctgtaattccagctacttggggaggctgaggcaggagaagtacttgaacctgggagacgggggttgcaatgagcagagatcgcgccactgtactccagcctgggtgacagagcgagacactgtgtcaaaaaaaaaaaaaaaatagcaataatgcttgctttccccccttactggaaccatgaagcttgtgacttgcgtttcttctcacatcaccatacagaaggaaattaacttataaaccagaaaaggaattttcttggtggaatatcaactttccaaagctgtcattggcattatctctatttaaggacatttgaattcgaattgtatgtgattctgtagaccctaccgctccttatttggtatgaggcaaagtataaataaataacgtttctccaacgtgacatgtagagttgcttcagccatgatttaacaagaagagaaaaagcaaaatatactcagaaaaaacattccttttcgtgagtgggtagcttattcttatagtgacaagtcacagattatctttcattcattttggtgtcattctagaaattctttataactgaattctggttttctgtgtagtaaccctttagggactgggaattggagttcaattctgtttaatcttcttcccagcccccctacagtagcttcagcaactttactattcctgtagaggctctattgtctttgtctctttacttggattcctcatttcttcctaagctacaaaacctatagctgatcatcctacttttagtaagctcctgattgctccagaatgtagaacgatatttttagatttttggagatggttatggatctctgtgaaaatccgatgaaaaactaaggctgttctgctctcaaaaatgtatattacatacagaattttgtttatagttctaagggattcatagctct

SEQ ID NO: 137792 - DNA, 2050 bp, Homo sapiens
ggtcaaggctgcagtgagtcatgaccatatctctgcattccagcctgggcaacagcaaaaccctgtctcaaaaaataaaagaggtctccttgggatctagctttttgaaatcctgttcccttgaatgaggagctttccctgattatcctattttaaaatgtagtattccctaccccccaactccgcatcccctgtttccttccctgcttaatttattttgattattatctgtgtcctgccactagaatataagctccatgaagatagatatttttgtcttttgtttacttttgtatccccagtacttaaaatacatgttgaatgaatttattttctttgtttctcagtatgatgaacatttgactcaacttgagaaggatatttgtactgctaaagaagcagctttggaggaagcagaattagaaagcctggacccaatgaccccagggccctacacgcctcaggtgagtctgaggactaagtacttcctcatatagttttcttattggtttgggaaattgggagcatgttaacaaatccgtttactgagataccattcttctctgtccttcctcttcatatgcctttcgtgtgctttcttgtcttctcaaaggctaaggtgagtgagggccatgggtcttggtggccttgaatccagaaaaggcagctgtgggatgaatgaatggggtggggccttagttgtttaggcagtgtttgggaatatcagatccctgacccagccatcctctgggtctcgggaattttcttgtccatgaattttgggactctagaacatccctagagtgtagacttctcagttacagacatgggccatattgttcctgtgccttacagacacttgattactcattccctcagagatatctcagtgtagctcagaagtcacccattttcctggattgactcctagtaaatgaagaaaggtagtattaataatgttcttaaatgttcatgtcaaaagaatgagagagcaggataaataagaaatttttagtcttcctggtctaactgaacccttgaaatacactaagagtatatttcctccatactgtactcttagagggttggcatatttgaagaataggacttaacagaatatcactggtgcttggtttctgtattggaggcactatggtagggtggaaagtacataagaattgacataaagcaggcctgggtttgagtcttagttctcctgctgtctagctttgtaatcttggaaagttaacctctctcacttagtttccttttctctgaaatcttttcaagattgttgtaaacattaaatgaattaatttaatttgcctgacacatctttatctgttctctgagaccctttcaaatttaatcaaatattttaatgcagaactctgccaattcccacaggaaaattttttttcattctatccaggtttccctctgaactgataatgcaacctatgtgacctctgttggattattgctgtctctatatctcgttcatgcactatccctatctatcttttactctctctttcatctcacaacctaggttactgaggggccaggtataaaagaaccctcagatacttcttcaaggtccagaacaaggaaaggctcttggagtgtgtgggcagattgggtcaagggggcttgggtgagtgatgttgcccaggaaggccctatttgctaataggcccacagcttccacaaggtactttctggtaagttaaagcctgggtattagccatcattccccaggagagtctagccattgaatggcacatggtttgctcatttctaggacagcctaagcctagtcctttggtgagtcaaagccttagaccccaaagtcaccttcctttcttcactacgtctcccagactacctcaaatggctaaggacaacctgttagctatttctctcttgagcattagctgtcatttggtgcagttagagggtttcctatgaagagtaggattagatagtactgcttcattattccagttcaccttttcatcattcccttcactcacaaacagtttaagat

SEQ ID NO: 137793 - DNA, 2550 bp, Homo sapiens
gctatttgtgttccttactcagatgcgccagggccgaggtaggctgggcgaggaagactctgatgtagatattgaagggtatgatgatgaggaggaggatgggaaacctaagactccagccccagtgagtatgcttatagaaagcttatggttacgttatgcccttatatgataggagccccatcagtacaggccaggccaaatcctaagatgatatcagggggtctccttagtgagccccaatctgactttaatccttgggaccaactaaacagtctatccaccaaaaataattacttaacttcttgtgaggcagcaagtggagggatgggcggggcggggagggggggtgtgcctggtggtggcttctggtctcttatgtggtcagttgataggactttgacccccaactggtctcattcaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctggtaggcctcaaccattgcttctattcctttataactcactacagcaccctcagaactggactggataggcgctcttggccacatatgcttttattggaagctgcctcttttattgaattcctattaatagacctgagagtactgagcactcaggcgtaggatgatcatattcattagcaggaggtacaaaagacaacagtggaaaagacagtgcctaagtaacagctttgatctggatacttgttaaaggctgggcacagtggctcatgcctgtaatcccagcactttgggaagccaaggtaggaggaacacttgagaccaggagtttgagaccagcctaggcaacatagcgagaccctgtctctacaaaaagtaaataaataaaaattagctgggtgtggtggcgagtgcttgtagttctagttaggaggctgaggcaggaggatcgcttgagcccaggacttcaaggctgtagtgagccatgatcataccattgcactacagcttaggcaacatagtgagactctgtctccaaagaaaaagaaaaaaagatgagaacagaatgatcaagtgttatatgtggcaacagggaaggaaaattaagaaaaatcctgtttggggatattttgtggattaatggcaatggccgaggaaaagtatgggagtagatggtagaaaaaatacagataggttggcatgagatggaaaaggaaattgttatttggattcagattctaaactacaaaccttgctgctgttgaccctaggcagttataagaggcatttgaggagaggcgtataggcaagatacctgtgtagatgtgtgagagttactagtttgggaagatcaagccaaagatcaagttaaatctgtcaagcttaactcttgatgacccagaatctgtctctttttacagctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcaggtaatcgacagcaacatgctacagggctgtggcatcagtgcccagctatgatgttgaggggcccaacatcagattacttttcatccatcaaacatttcctgggcacctactagggccaggcactgtgctaggctctggggatacacagaggagcaaaacatatcctgcccttgaggagcccacagcctagtggaaaagactgacacaaacaaatcattacaaatacaatgtgataagtgctatagcgtaagtaagacaaagtgccaaagcaccactgagaagggagtgtctcagtctgcttggagttatcagggaaagtttcacagacaagggaacatttgaattgggccttaaaagattaataggagtttactaagtaggtactatggcagggggtggggagaactttataggtggaacaatgtgttcaaagacacagaagtagaacacaaagtatgttccagagcaaatggaagttgttggggagttgaggctccagaagtgtagcaagggggattatattgtgaaggactttaaaaggcatgctaagacctttggaccttaacctgcgggtaataggagtcatcagtttaaggaaaaggaagtaacatcaaatttgtataacttaggacaatgtgggacacatgatgaggatatcaacagggacttgtcaggagtggggaaaataaagggacataaagaggtaaggaggttagatgaataatgaatggagatgtctggtagaggaaagaggaagaatacatattagatggggcaggaaaggaggaaaaaatggatttggatttggctttggacaagttaaatttaatgtatctatgatacatctaaccagcaagcagataatatgcaataa

SEQ ID NO: 137794 - DNA, 3419 bp, Homo sapiens
ctaatagtggaataattggagacagcttaaatgtcctagtgagagactgttaagtcatgttacagccatgtgtggaataccatgtagctattaaaattatgctatagacgttatgtttattgacatggaaagatgttcattataatcattagtgaagagggcagatttcctggagagtatgtagagtatcccaattttgtaaattaaaaaaaatgtttaagcatctaaagttcacaaaaaattttggaaggtaatataccaaaagattatctctggatgatggagttattgatttttttaaatttttttctggtgtatattctaatttttttaaccagtgaacgtgcattacttgtgtgatttttttttcaagtaaaattaagaataaacaaacaaacaaaaaaataaagagcactctggcagaagtgtgaagaagtaattggaggagagcaagactggcggcatgacgacttatttcagtagtgcaggccagagataacaaaggactaagccaaggtaggcagagtagggatggaaaggaggggatagagacaagatatattgaagagagaatcttcaggactattgactaattggatactgtaagtggtagatgaaaccatgaggctgtcagagcatttatggtcatgtaagatggcagtgtgttgttcaggtgtaagggagtttcttccattcaggttcttgtgtatatgacgttggcaagttgatgtttttgaacagggtcatttttctctcagggacatgtagaatagtccagaaccagtcactttagtgtccaggggaggtgagatgggctgatcctttggtggcactgagaatgggaatggtcaggtagaggatggtgtccgagcttgagagatgacatgtttctcttctcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccagcagtagtgtggagaatggtttggatggatctagttcaagtaagagagaatggagcccaaactggtgctatggcattgggatggggaggagggggatggatttgagagatctttagggagtaggacttggcatttgtgggtagagaaggaggaatggaaggtggcttccagaattttggttggggggattgggtgagtacatggtattcattggttcattttaacatttatcatgccacctatttttgttttgtttttttagatggagtctccctctgttgcccaggctagagtgcagtggtgtgatctcggctcactgcaacctccacctcccggg

SEQ ID NO: 137795 - DNA, 4536 bp, Homo sapiens
cagaattgatccgtgagagtcgtaaccatccgtttttgtacgaatacagttgataaacttttttagacgcctttggcatttatgtttaaaacgacaccacctgctaagtaacaaacactcttcttaatcgcggtggcaaaaacgtatccgtcccgtgtgtgtttgtttttacccttccgctacactcttaagaaacttggccgcttccgccccagagagtgccctaaccacgagtcgggttgacagggctgctcgcatgcgcggtctccaccgtggtgtttgtcgcaatgggcgctgcgcggaggactacatggaatctcgactttgcagcttgaagtcattttgttggcggcgctggttaccggctacctccgcgcgggcacttgattgtaacagaaagtagttccggcccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctgtccgcggggaaccacacccttcccttcgcgaggttgccagccctgttcacttcctatccttgggggagaaaccaccccgatgctgctgctttggcgttgaccaccctgcccgcccaattctcgctttgtgttactttctcgatgtattcctccgccgccgcctctgggtctgccatccccattcttcagcccagtatctctttattcacagggtgtaatattcttttaagtttccatccctgcttgaagagtttgtaaagcaactggagtgtagctgcacaagtacaaggcggttgcccttttagacacttcagtcgcgagcatttggtactgaaaatacgaaaacaaccaaattgtaggagtgtccttcagctgcctttccatattgaggcgatttgggcggaagggggtggggaattgggctgcgcttctgaggtttcccgcgaggttattttttggttgtttctcagttgagatgtgtggagggttttagctactgttcctggaagttgtgctgtaagtagtaggtgaatcgtcaatagtgtcttatccgtaattgtagggagtgggattaataattagtccgtgctcctctccccacgtctccaccgtgattttcaaaggtttaagattctgtactggattctgtactagcttgccctttttaatgtgttatttatttgagaaagctgtcgtttcaagtgttaaaatagcagataagcggcattgaaaagtgacaaagtaatgtgtgaaaacaaggagctaggaagttctagagacttagctaaaatgtaattttagtttctattaaagatataacctctcccagatgtggatgcaagtctcaatgctctttgtgttggtggtcagctgtgcattctgtcaggaaatttactttgctttcctcagtatccggaacgctcatcagctctgatgattggggagctgggctcaaatttgaactagtcaccttaaccttggtagaattaaataatttgtccatggtttcccatttcaaccagctagtgaagtgctacggtcgaattcccagtttaagtatttacagttgtgacaagcagttttttttttttttttttccctctctgggctttagctatatcctttaaagatctttatgtatctggattaagtcacttgcagcgaagtgcttttatttattcattatgttgcgctttatcaaatatattttagcgtccatcctccctccctcccaacgttttgaccattgcagttgcaggtaactgcctggcttatataggcttgtttgcaatgtcttaatcctttagtcaataccagagctgtttggaaaatgttagtgctaaaccaacgtgggtgggatttagccaatttagtctccttttgagtttgggatggtagaggagcagtgtaatcttgggtctttatttaaaatgtttgatgacccctttaactattttggctgttgtcaaatgacaaacatcttgtttatcagctgttttaaaaatagcactttgactttttggtttttcccttaggctcgtttctacttgtccttttaaagaattaaattctgaaatatacaaaaattgatataatttaaagaattaacacatctggtgtcctcactgaggttaagattgatagattgttaccagtactccacctcaacaaatccaacctgaaatatggcacaaaatattacgtttcccaatatgttattctgatattattaagtctttgtgaccttgcaaatcacacgtttaatattttgtttctgtatgttaactaaggtataaggaataatgttcagtgaatccttagatgctacctatgatttataatttaaaagtacaaagtatttttggtcataaaatgtaatctcatatggaagtaaatattcctttctagtttgggaaagaaagtattaatgggtgaattctaaaaatgccaattctgcacttgatgttaacttgaagatatacataacgtgcagaacactctagtgctttacatagtttcaagcatttccatttttaagttaaatataccatatttttacatttttttggtttacatttctaactttttgttttcccccctccttccctcaaatgttttgatgattctccagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacaggtaggagatgttggggtacctgctcgtgattgctgcctctgggtgctgagcttgaaaaatgatacttaaatatttgaacttgaaatttttccagtaccgggtttcaactgagccgccaacgcacatctgctctcttgcccacttgtgacatgcccagctgccagtttttctccttccttttgtggtggtggttatattatcagtatgactagggaccttttctagatttttctatctgggtctgctgctttctagactctgttcaggtaataaattattatcaatgtatatctgagcatccagtctccctttcatgagacctgtcagtttgagggactgaaatgctcagaaatgatggttatgtatgctgtggcaggagatgcatacctggagtttcattaagttgttatggtgtgttgcttttagttaatcagttgaattaatcaaaagggaagaatttgtgttcctgtccttttaataattgttattctggcatatttagacacttaaagatgtgcatcattaaatcttaaatggaaaatgagactcgtgcacatagctttccattttttatcttaatgatcatgatttccaatgtggtgggtttttttttttttttttttttttgagacggagtttcgctcttgttgcctaggctggagtgcagcggcgccatctcggctcactgcaactctgcctcctgggttcaagcgattcttctgcctcagcctcctgagtagctgggattacaggcatgtgccaccacgcccagctaatttttgtatttttagtagaaacggggtttctccatgttggtcaggctggtctcaaactcccg

SEQ ID NO: 137796 - DNA, 1025 bp, Homo sapiens
tttgctcttgtcacccaggctggagtgcagtggcgcaatctcagctcactgcaacctccgcctcccgggttcaagcgattctcctgcctcagcctcctgagtagttgagattacaggcgcctgccatcatgcgtggctaaatttttgtatttttagtggagacggggtttcaccatattggccaggctggtctcgaacacctgacctcaggtgatcctcccgcctcagcctcccaaagtgctgggattacaggcgtgagccactgcgcccagccaataattttatttaataagaaaaagcttttcattttgaaatctagaatacctccacttttgaaaatctttgatttcccaaatttttcttgctatgcactagttaaaagataaggtattatataatgagcaatagcacagatctcaaactgtttgagttgcatatgggccataccttcttttctgtaacgtgcatacccatgcattaacacttgtcgccttttccagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgtgagtaaaattttaatggttactttcccttcctagaaacccagaaagaaacatagtgtgatatttcagacactaaagtaggttttcacatggaataaagtcaaaagtttagaaatgcgtatgtacttaaaatggtgaaattgcttttagctggtctgcgttatgctaaaatatttgttttatttagcaagttatattaaaaagcataaaaattcttattgcaagaaactacatcaattttaaaataacacgtataaagtacagagcacatgacttttttc

SEQ ID NO: 137797 - DNA, 9676 bp, Homo sapiens
ctattctcttctctttcaatgtaattagaagtcatagaatttagatgatactacttatactgggcttttgattagtttaaaaattttttttgtctaagttgcagatgtgttctgggaacaagtaaggctcagctggcagaccttaaattcatactgtgtttaggatctccgaaagatacaaaaacataagactttccctcagaacttatgatgtagttagagaaagtagatgtaaacttaagaggtaaatgatagtggggttatagaaatctagaaaaagttcccaagttacattgtcaacattcagttttgtaaccaacctggaaatggctaatagtttattttagctaccgtttactgaaagtctgtgtggtcagacactctactgacagctttaaatgattggtcttagttaatcctcacaataattcttcaaaatagatgatattatttctgatttttatcaattaaaaaaaaaccatggactcagggttatgtggctttcatggggacaaagctagtaatgaagtattaatagatattaaaacctgagtctgaatatcctcaaagcaaatgttgaagtgaaaagaaataaaagtgggatgatgtgcccagagggcactcacccatcaaagcagcccttgagcacagttaaaaaaccattgatcatattttgctgtcccttattttttggttaggaaactgaaactaaatttagtagtttgttcaaagatccgaagtcacttctcatgatgatatctattaacaatttttgtagttaattttgagagtttaaacgtgtcctttttagaaaatccattgctttaaaaaacatttttttttaagagatggagtcttgctatgttgcccaggctgtactcatactcctgggctcaagcagtcctcctgcctcagcctccagagtagctgggactataggtgtgtgccaccacacccagcttctaaatttattggtttttgaatggatacagtgaatacctccagttagcactcttggaggtagcaaatgaaactaatttcttgtctatcttttctgagacactcagtgtatatatatgtacatttgagtgactttttgtaagttttattgcaatactaatctagctagttacccacataaagttttagggagcctggtatgtactgccactgggccttggaccccatttttcccagggctcagggctcacctctgtacccagttgtcacagtaagttctttacctttattaatcaggttgattctactcttattgatagtgtaccctcttacacagctgtggttcttgccatctttaactctaatgcccttggctcaggtttccagttgcctatgtgtgtagcagagcagtcattgctactgatagtgtacccaagcagtaggactatgctgagaaggaaaactaaagtgagagatggaaccttgctatttaatatctaacctgctgttagcaggaagcttattgttgtaccctaccaaggaagtgagatagtactaaaataaatcatgggattacctcttgaatgcattgaatggccatgtgttgtcatctggttctatgtttcttctagtggaaggtgctgctttacttatttattactgtttttaccaataagaatgaaaatgggattgtgcaagttcccttgatttcaactaaacatgccatagtgatcatattttaatttatttcaggatatctaaagtcttaactagatttaaacttactgtcaaatgcccgttgtcagttcagtactggtagaaccttgcgtctgttccttatgttcttgttgacagtgcttaaatgcatcattagtacattgtgtacctgaatcatagatgtagttggcattctatgaaaaatggttaaagaaactcaggttattttggttttgcagcagtgaaagagtagaatgttaaggtggtatctttggtaaccttggtaactgttttcaacagtgtttatctttttaagttaatagatatgtcaatttagaagttgttctctgtgacttgattatagaaattatctttgagacagctatctcatttttttcattctgaattatcttctataattataatgttgggtgttttcataattttggtaagattttagtctgtcattttttttttttttttggagacggagttttgcccttgtcacccaggctggagtgcagtggcgcgatctcggctcactgcaacctctgcctcctgggttcaaacgattcttctgcctcagcctccgaagtagctgggatcacaggtgcccaccaccatgcctggctaattttttgtatttttacaaaaacaggctttcaccatgttggccaggcttgtcttgaactcctggcctcaacagatccgcctgcttcagcctcccaaagtgctgggattacaggcgtgaaccactgtgcctggcagtctgttgtatttgaaggtgttattgcagatagcaccttgcagtgacagcacatgttctttgacatggtgactcactagagttgcctatacctggcaattccttttgcaaattatgtataaaattgtcctttctgtaacggctataaccctgagttgttttaaacaggtctgtttctgaatctataggttgttgaattgttgcttgtgctttgattgtggatgcacagaatggagagctgctggcatcctggccatcatgtgtgttcctgtcatgttatttgttacttgttactgctgagcctctcttatacagctgcactgtagaaaaccatatatttcgattcttctctgttctgctttctgttgtatatttcgattcttctctgttctgctttttgttaaggttgctgtgcaaatgtcacatttaaatatgtgagtgcttattgtgcatacaatgctttgttaggaaatggggagatgtgttgtgggggaagttgcgggttataatataagacaggacctgacccgtaaaggaaaaaatggtgtaagttccttggatgataattgttggagagtattaatcagaagatttcctcgagtgggtgcttatgacctaagcattctgtaggaaggtaaatagcaagtagacttccttggctgaagtggtgagtcaagtagtaacaagaagtgaatgtagtagaggagagtcaattggaagatttataaagaatagagaggctgaggagtttgaatttaatttgagaggcaattgagaattactgtaggtttttatcgacctgattttacttcatatgtatgtacgtgtctagatgttgtggctggtgggggtgggaggctctaggaggaaaggcaggaaactgatgcaatcttaggagaaatagttctacaggaaaatcttgctcatttctatctccttttattctcacgattttcccttgtatacagtgccctcctcctttgtctattaaaaccctactcatccttcaaggcccagcttaaacttctcttatgagctcatcatctagttctcttaaaattctttactactgagtgggcatttagtgtgtgccttgtcttttcacatagattgtaagccccttgatgataaggattctatatcttttccctatagttccaggcatgttattgaattgagtaacagtttgcctgaaatgtattaacctgggatggataaaatgggctagttttgagaaatataattgtcaaaaacattttgatttgacagatgaagcagaagtgatgtcttgggttttgaacttttgggagaatggtggtgcccgtgcgttttctagaaattagctgttcatgcacataggtttggatccccaaacaggagaattggatttcaccgttacatttaatatgatgttttagcttttcctaaaactgccttattgattatcttatagtaatcttgaagataatgtatttttaactatgagcattgtgttaacttgatatagtatactgtaatggatctagatgataacaaaatatagatatgctgtcaggacttaagtggcatccatccaagagttcatagaaactagagggtaataaaattacgcaacagctggctactatgtatggccattacagtcattgttggagaattattgcaagacttctgattattatgacttagaaaaggcataggaattggtaaaagtccaaacatgtataaccacaattatcaagtagtagaaggagcttgtatgcatggattggattatgcagtcatggtctgccaaaacaggggtaaccctttcagtttagaaaaaaacataaccatacaaagtagatagcaagattatataattcattacttctgagagtatagtgttaaaaagtgctcaggctaattagaggagaagtcaaataagattaatggtacctttgatgttttgaggattagtattagccttttgtgcttgaagtgatgggagacaaccttactctctagaacatcagtcattgcttgaaggacagtattgagtcagggagatgatggaactgacccagtatggctgaccgtaagattgttgtgtggcagcctgtactttgttggcagactttttggttcacctgatggatgatactatacaaccacaaaagctgtttatcagtagaattaagtgattttggaaaccataatatagttccagagcaaatcatatatatgatgatttttcggcacagttgacaaaatttcactttctaggacttaagtctctttcacccatggaacagtttggaataataagcatacttcctgttgtcattgtttctgcctgttgactggtagatgtgactgacaatggcaaaatagggcaaataaaaatttaagctcactgttgtgatgagtgtctcatccagatgaatggactgatgagtcagatgactagcagcacaattgagctgctaataaaaagcagagtcaactgcttttcattattcacccactcaactctaatggcacttaatactaatgagtaatctagtggcaggtgccaggattgaggctttggttggataattcttctgcccgatagtgaaatgaagtcagagtttctaaatatgcctgacagcctaagggtaggtttgctcataggtagtcatttgctaaatatgtttttttccactctggaaaattttcggtccttgatacagaagtgattcatcataaccttgaataacatagttggacaaatatttgagatgtgtgtgtgtgtgtgtgtgtgtgtgtgtgtgtatatatatatatatatatatatatatttccttttttttttgagacaagagtctctgtcgcccaggctggagtgcagtggcacgatctcggctaactgcagtcactgcctcctgggttcaaccgattctcctgcttaagcctcccaaatagctgggattacaggcacacgccaccatgcccagctaatttcatatttttagtagagatggggtttcgccatgttggccaggttgatctcgaactcctgacctcaggtgatcctcccacctcgccctcccaaagtgtggggattacaggcatgagccaccacgcccggcctgatatatatatttttaatgtgactgacatttggggaggagagaaagaagctctagtaaggtcccatagtattttatgtgaagctaatggggccaaatgcatttcaacattcagaatttttaggatattagaaagataataccatatataaaacacccagaaaagtctggagcagcaccttttagtaaaacacatttatatttctgcagcaaaagacagtattcatactaagtgagataattaaattctataaatagtttcatgtcacctcaagtcaggtttaaccctcaaatgagtttttggaactttttgggatttggaattgtggatgaggggttgtggtcctgcactgaagtttgtcaggcagtatctttagttgatagaataaaatggcagggagctagatgcttaaaagtgatttcaagatatttttaattgacaaagcagagtataattaatgacagcgtctctgggtttctaggatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactcctttttttttcagccatacctcttaacacctcatagaacacactttgggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggttagtcattaaattaataattggtatttttgaagtgcttacgcatgtagtgtttttactagaactaaataataggtcttagccagtgacattatatctttgtttctctggcggtataggcagtatgtgacttacagagaacaatgatttgacttaaatattttttcaacttgacaatggt

SEQ ID NO: 137798 - DNA, 1527 bp, Homo sapiens
catgcctcagcctctcgagtagctgggactacagttgcacatcaccatgcccaggtaatttttgtatttttagtagagatggggtttcaccatgttggccaggctggtcttgaactcctgacctcaagtggtccgacctcggcctcccaaagtactgggattacatgtgtgagccactgcacctggccggtgttttgattgaagtttgcatttaccatgctgtaggagtatctttcttgatcagtgtttctcttccttggttatacatgaggagcttataaaagatctgaatatcctgaccctatcttcagagggtctgatttaactggcctgtgatagagcctcggtaccttttctaggaggtaaattcttaatatattgccaaggttgagaatcactgctctagacaacatgacagctatttggatgacaccgtgtaatggttagtatttccttgaagtattgtatcttactgtgtatacagctctaattgcatgtcttaataaggtcttgctgagcatgtagtttgtatgcatacaactgaggtatatatttaccttttcagtaagagtttgctgcctcttttgccactatttttcagaagagttagactggttaattgtgaataaaatagggccaatcattagaagtgttcagtttaatgaaattggagcaggcccaatatttaatttttctcttcaggacccattttgctcatgagaacatgaggcatgagaagttattttgataatgttgaggtttgtaaaaataatgagaagacactaaataaataattggtttattaaaatgaaatgtaattgaaagtctgcaaggaccttggagtaaaaaaattgtaattgggaagttgatctggtgaaatcctaacttgctctgagtaactaactgtcttgaaatttttaggctgtcacccttgacccaaactttctggatgcttatatcaatttaggaaatgtcttgaaagaggcacgcatttttgacaggtgagagaatgttctgtttaataaattttcttgaatctttgttgtattgacacttgacagtttggaccgaaatgatgacaatagtccattgaagcatatttgccttttctagcacgttgttctctgcccatgtcctgtgttgccttttatttatagatgttgttcgttgcctgactttttgttgttggctttcctcaaagccgttatccttctcattgggagtttagttgaaatttttttattgttaaaatggttgaaatgattctttcttagactaaattattcctttgacctgattttagaaagcaaagtaaatccagacttttaaattttttgttgttgtcaaaggaaagcctattttttatgtgggagtagaaaacttcccagtgtaaagacacattttataaaggtgtgattttggtttgaggttaaaatataatacagcatgaattatgtaattaattacaattacttgatatattttgatatagtacagcttgaatgagttgtaacaaaccatccatta

SEQ ID NO: 137799 - DNA, 2672 bp, Homo sapiens
acttcgggaggccgagatcagaggattgcttgagcttagggtttcgagaccagcctaggcaacatgacgaaaccctgtctctacaagaaatacaaaaattagccgggcatggtggcacacacctgtagtcccagctccttgggaggccgaggtgggaggatcgattgagtcctgggaggttgaggctgcagtgggccatgattgtgccacagcactccagcctgggcaacagagcacgagactctgtctcaaaaaaatcacaaaaaccaaaaaacagcaaaaaaggaaagtcttttgtacaagtattgagatggtatattggtttactttagagttttggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtatgtgagggtggtgtagctgggcatttagcatgatagtagagggaaagcagttaagtttaccatcatccacctcttttgtaaaaatagtggttgaatcatttacaagaggattattcattgaagtaacaattgagtacctaaggtatgatgtgaggccctatgtgacattccagaaaatccctgcattcagagttcattattctgtggataagatctgtacaaaaaaattaaacattaacccacagttcaagagaagttacttataagtatataatcttagtgcctgatggctgtatggtagtggttagtagatgtggtaggagtttagcagagagagatttcagtggtgttggagtggtcaggataaactaagaggagaagaggtgtacctcattatgtttgaaacaagaagaggtataaaatagaggaagaggtagaatttgagaatgaatagacttggaaaaagtagagacaaatttaggggtttaaatgtacttgagcaaagttcttaaggttgtggtgaattattactgctgctttagcaatttttttaacctcagttctgatcttgactctttataggtcttcccagagtttgctgctgcccattcaaatttagcaagtgtactgcagcagcagggaaaactgcaggaagctctgatgcattataaggaggctattcggtaagagacactaacagccttatttttaaaattatttttaattttaaaatgtttgacattcggcacattgcagatgctaaaatggctttaaataacaacggaataagttagcattacagtgggttaaagatttttgtattggagaaataaaacctttggcttctcttttagaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggtactactgtttattataatatgtgcagtttaacacctaaaatttaacttttggaaattttttaccatcctgctttatttattttccaggattcagggaatattccagaagccatagcttcttaccgcacggctctgaaacttaagcctgattttcctgatgcttattgtaacttggctcattgcctgcaggtaaagaataacaggccagtaattggctctcagtgttgtaatagctttttaattgttgtatgccataagaatccaagcctgactggaaatagtatttttaataggctatctgacattactttaggccaaagacatatcaaatattaaatcctgggataggactttctggataataacttgtttttgctttctctagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataaggtgtgattcttttgttttaatctttttgttgtaaactaaaacacaaatacagaaaactgtaaaaatcaaatctgtggcttaatgaacgattataaagtgaacaccacccaagtcgagaaataaaacttttgtgggccacttcagaaccccttccattgtgtcctgagtataaccccctgcacttcataagacggaatccttaactccttcacttaaacactaatgatagactgatggtacttttctttaagttgaaagccataatttttttttcttttatcttttttttcttttttttttgagacggggtcttgctctgtcgcccaggctggagtgcagcggtgtgatcatggcttactgcagccttgacctccccgagcttaggtgatcctcccacctcagcctcctgagtagctgggactacaggcgcatgccaccacacctaattttgtgttttttgtagagatggggttt

SEQ ID NO: 137800 - DNA, 1610 bp, Homo sapiens
ccaccgcgcctggccagccatcatgtttaatggagtgcttggtattttgtattcacctttgagaattagagcagtacttgatcaaggattggatcaaaggttggataatagattggagtgctaggtgtactttttttttttttttgagacatagtgtctctgtcatccagactgcagtgcagtggtgccatctcagctcattgcaacctctgtctcccaggttaaagtgatgctcgtgccttagcttcccgaggagctaggattacaggcgtgtgccaccacgcctggctaatttttgtatttttagtagagatagggctttgccatgctaggctggtctcgaaatcctgacctcaggtgatccacctgcctcagcctcccaaagtgctgggattacaggcatgagccactgcccccagccataattttgtttttagaaaatgtttccctatagaattttctaaaatgcgggaggaaaccatgctctgtccatactgcttcatacctacaagtgttagatttgctcgtacttttttttttttttttttttttttttgagacagggtcttgctctgttgcccaggctggagtgcagtggcacaaccttggcttactgcaacctccacctcccaggtttgggcgattctcccacctcagcctcccaggtagctgggactacaagcatgtgccaccacgcccagctaattttttttttttttttttttttagtagagattggatttcactgtgttggccaggctggtctcgaactcctgacctcaagcgatccacctccttggcttcccagagcgctgggatttgctcatgctttatagatctcaggagcaggtcaaagtatgaagcatattacataaagtgctgaggttgcatctctctggcaatattaactaaatgctctgggcagacctttttcaacaggtgtgaggtataggtttggtgtgtttttcgtcagttttcctagatgaaaatttatgtagattttactaacaagcattggattctgttgatagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtaagactagtgtttctctagaatcactatttgtttaaaaaagaaaaaacccacaatgttggcttgtcaccatgaggcatggaaacctagtgtcttttggaaagatttgagccagaaagatttgagccaatgttattaaatatgccatgtgctgcctttcaggtgttctgttatgccctgagcccagacgatggcacaaacttccgagtgaaggtgatggcagaagccaatcatttcattgatctttctcaggtagatgaaactctcatactttaactttttattttgagcaagtttaaataaaactattagcatatagtttatttttgatgataagtattaaatgctgtagtaccacatataggcaattgtgttgatcttatttccttgatcatttgtgttaatcagcatggctttttc

SEQ ID NO: 137801 - DNA, 4107 bp, Homo sapiens
cgaactcctgacctcaggtgatccacctgcctcggcctcccaaagggctgggattacagatgtgagccaccatgcccggcctactcaccattttctaaactccctcacactttactctagttcttcattcatactgttctctactgagattgtattctgttaaactccttcaaactcctattcgtctttgaagacctattttcaaataccaattctaggctgggtgctgtggctcacgtgtataatcctttgggaggctgaggtggaaggattgcttgagaccatcatgggcaacatagtgagaccccatccctaccaaaaaaaaaaaaaagattacaaatttcaaataccaatttctctgtgatatgttgttattcatacattcaatccagaagtgaactctccttcctttgtgttctgtttctttaatgctttgggcccattttaatgacagtcaaccatatttgtgcccgaattaatgtagttaatttgtgttcttacctcttttccatctgggaatctgaattatgttaaatgccattaaaactaaatgccattaaaactaaatgtcattaaaactaattgatctgagattatacatagtgagttcttattttgtattctgtagattccatgcaatggaaaagcagctgatcgcatccatcaggatggaattcatatccttgtaaatatgaatggctatactaagggcgctcgaaatgagctttttgctctcaggccagctcctattcaggtaaacaaattaacagtcatcacttataacatgtatttggctaagaatacagtgaggtgctgcttttcctccctctggttaactgatatttgaaactgtagggcagacatacttttaatttttttaagttgttgaaatgcacaggacaaaaagagtgtagagcacagtgcttataggtacatgtatatagagacatgcaattcatggttggctatgaacagttactctgtcttgcaaatttgaagaacattttagcattttgaaagttagtctgaaatacaggccgggtatggtggctcacgcctgtaatcccagcactttgggatgcttaggcaggaggatctcttgaaaccaggagtttgagtcctgcctgggcaacaaagcaaaacaccctatctctacaaaaaattaaaaaattagccagagtggtggtgtgcctctgtgatcccagctatttgggaggctaaggtggaaggattgcttaagcttaggagtttgaggctgcagtgaactatcactatgccactgcactccagcccaggtgacagagtaagagtctctcttatagaactgcttcattgctttcggctaaagaagtcagccttgctgtgcgtgtggcaagtgcctgtaatcctggctactctggaggctgaggcagaaggattgcttgagcccaggagtttgaggctgtagtgatctacgattgcaccactgtattccagcctagggaacagagtgagatcctgtctctaaaaaagagttagacctccttgtttatttacttatttaattttggcacctttaggttctttttttaaaaaccactttattgaggtacagttgacatacaaaaagttgtacatatttaatgtatgtgacttgatgaatttagaggtaagtgtactgataaaagttcttaatcagtttttgatctgatttttttaaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaaggtaggtatgaaacagtgctatggacgaatttcaaagaactgtagctttttatttccttgctattgtctatgtaaatcctaaaagacatgtctgaaactattttttccattagaaaaaagcagtcatcgattttaagtccaatgggcacatttatgacaatcggatagttctgaatggcatcgacctcaaagcatttcttgatagtctaccagatgtgaaaattgtcaaggtcagaacctagtcagtattgtcattgaaataaagttaactgcattcacgatcttttccctaatgatgcatttttttttcagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcaggtgagaagataataatacaccattatatgtcccgccaagtatgcatttatttcccttaacctcatgataactctaggaggcaagtatcattatcaccatttttatggatgaggaaatgagtttagtggaaacgtgcatcttatataggtgtgtctgattttaaaagtctcctggattcagccagcagattattacttactgagaaactgctgtgttaatatcttgttattccctgcctgtggctttactctcttacatgatgaactatgtgtagattccatacagtttcttgcttctgtaaacccatcctttccctagctaaatcctactcaaacgttcagttcagacagctcttccaggaatccatttccgtacttaccgctaacgtctccatccctacttcattggtacctgtcttttatacctctgtaatgtttggaatatatcattacatacagcacaacagatgataattccctgtgtttgtatcctctactgaattgaattactgagcccatgtcttaatcacagtaatgtagtatgtactcaataaataatatattgcatgcttaaataagtagctctatcaagagagtgtaaggcaaagatctctgacctctagaggtcatagatgtccttgcacacctggaatagttatataacaatgtaaggcagtactcaaatgtgtgagaattacaagatgaaactaattatgtatgtagaagctcagaaacggtgaggatcaatgtgaagagagacactcttgggagaagagaccatttggaggagtaatttagccttgaagagtagatgtgatttagaaaaggacatttcattcatgaagaaaagagtgatcaaaagctgttggaacgttaataggattttgagaccttttttggttagagcaagaagtttcatagtgcagtctcccccaacttaagataatgctgcaacggtttgccttttcttaaacttcatatatcatgaatattttctcatggttcagtgacttttaatggttataccattttggatcttatggattgaaatattggactccttttgcctttaaatataaccatcatttttttcttgttctagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacgtgagtatgcaagtatgttagagactaataaagattttgtatctagagcttcttgctgaagatggtccttccactcccatttaggagctgttctgctcatttctttttaaaatttttttttggctgggtgcagtggctcacgcctgtaatcccagcactttgggaggctgatgcgggtggatcacctgaggtcaggagcttgagaccagcctgaccaacattgcaaaaccccgtctctattaaaaataccaaaaaattagccggacatggtggtaggcacctgtaatcccagctactcgggaggctgagacaggagaatcacttgaacccgggaggtggaggttgcagtgagccaagatcgtgccattgcactccagactgggcaacaagagcaaacctccatctcaaaaaaattttttttaaaaatactttttaaaaaatttattttatttatttacatgtgactcaactgggttatgccctttttttaaaaaacagaa

SEQ ID NO: 137802 - DNA, 1514 bp, Homo sapiens
ggccctttacagaaaagaccgatttatattaggcaaagaaagttaggcaagtgtgaggtaactttcttggttgtatcatagtgggggatttgaaatttggaatgcaaaattcctctctcagcaaaacccactgcctgtgtcaattcccgcaggaggtagctgcctcagattttgcctgtctttctttgaactcactttgaggacagctaagcagaagagggataattcaattgatctcattcatctctgtgaaggaaagacttaagtccacagcaggcttctatctggatggaaagaatagagtgtggtagaattattagagacctctgggagtctttgttgaaaaaggcagatctgctattaataattattcttattttccctattttagattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggtaagttgctgataaatcactggaatcttccttgttcctttgaaaatctccgtttgggggagaaacttccaggtgaaattatatgtactaggagcaacattaaaggaaaggtgatagaaagtgagacttgttctcacttcattctcttcatctgcgttgtgtggaggcttaacataaataacattaactctgtgctgttttacgttctcagatgtgcagttgttatcttttgtattacaggagagactcttgcttctcgagttgcagcatcccagctcacttgcttaggttgtcttgagcttattgctaaaaacagacaagaatatgaagacatagctgtgaagctgggaactgatctagaatagtaagtaaacttttccttgaacaaattatttggtaaagtagagagaatatagctgttataaaatgaaaccataaaataagtgtaatataaaataggtgaactagttgtatgccctctggatgggagaagtacttctaaactcttagaaatgaagtgatcaataggttttactatgtaaaaagtaaatggctgaataaaaaatattcaagaaaattaaaaagcaaacgaggggaaaaaatcttttgtctcagataacaaagtattaattacctggcaatgtaaagactgcagaacatttaaattttataatcccctaataggaaagtaaaaatggaaatgaccagacacctcactgaagtggaaatacaaaaggttaacaagaaagtgtttcaggctctgtagtagaaatgccaattaaaatggaattgaggctgggtgtggtggcttatgcctgtaatctcagcactttgggaggcttaggcgggcggatcacttgagatcaggag

SEQ ID NO: 137803 - DNA, 3071 bp, Homo sapiens
ctttaacttttgtaaatgatgcttcaatgaatatctttgcatggtcctgtatgtttttgcatctgattatttctttttaatagattttaaagtgttactgttaggccagagggttatgaacatttaaggttaatacatacttgctaaattgcttaccaaaaaggtaagcaacagtacataggaatagtcatgtgccgttgtcaattcttgttattttaaaggtagaaacaagacgaaatggagaacgcgtggtatcccttggatatacttgtttaggaaagaactaagttttttcagagtatatggagttgagctcatttcagtgttagcattatgcaagatgtgacccttccctttttagcacgaagccaatcaagaaatgagatagcgtagagtttggtcatgcattttttgccacaaatgcgactaggtatttatagggtgtgtttctgagtttctgctctgatttgtaaactgggttcttgttttttattacccagcctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaatacggctgatgtattttgtatcctgttatattgagtgttggactgaagaatagtgtcatccaatgatgaaacctatatttaaacacctccaaacagcatgaaaggaccaaatttccctactgtagctatgatattaggaattgttttctcagccaggtctggtagagggtggggttagtttatgatccattaagaaggcaaagtggccttgtgtggtggctcacgcctgtaaccccagcactttgggaggcggaggcaggtggatcacttgaggtcaggagttcaagaccagcctggc

SEQ ID NO: 137804 - DNA, 1002 bp, Homo sapiens
accttgaattcctgggctcaagcgatcctccccgctcagcctcccaagttggtgggattacaggcgtgagcctccatgcctggtgttgctttcatacctttaaatggaaataaattacttggcagaaaacaggcttttcactgatagctagcgataactcatctaacattcttcccgtgtttttgattcagcagtaaggactgagcagctcattgcttccaatttttgttcacttgtgctgttgtgatcctaatttcctaagggcttaaagcccttaaaaccttttttgcatttcaggaattctgattggttgttttcttcacttatttgggatttttgataattggttgcttatggcgtcgatagccctccttttataaagtatctcttttatttttgcagttacatccttaatgttcagtcaagcagtgatgacaccagtgggtcttgtaagtagagtccactcaaagcaggaacattttgaagtgtctttgtagagatgactcaactgtgatttgggatgtctggcctaagttggttctaagttcgtcacctctagggctctctttaggtcggtgaaatgaaatttccctactgtcaggagtggaggaggttctctgcttcttttccaacttactttcctcctttttttttggctctgggtttccttacttttatttcctttctatccttcatgggagatgtaaattttaagcagctctaatttatagactttggttttagggagttaaagacataggcaaccagattttttcatgcttcagatgttttctaatgccctctttctctgatttagctgtggccagaagagctccgaagagacaggcgaggtgagtaggagaattaatgaaactttactttttttttttttttaaattaaggggggaaaaaccccatgctctgtctaaggaaatttaagagtaaacttcacatttcctctgtggacactctgtggttctcagcaggatcatgatggctgtt

SEQ ID NO: 137805 - DNA, 1153 bp, Homo sapiens
tgggtggtgcaggtgcactgctgagtttgacacctaccagagcagtccgtcagttcaagagggtggtgctggtttggggttgcagagagtagcactgaagagaaactccctactctgaggctgcctctctccatctgtggccctctacccttctcagacaactggatctcaaacttgataaagaaagatgacaactccctgatcaattttaccactgtgccaaaactatctgaatacataaaatctgacagagcccatttcactctcagtatgtgacagactcctcgttttagaaggatgtgagacagatggaaagatgtaggaagatggaaaaagagaaaaagatagaaaatcaggtagaatggaaggattgagtagttccaaaggaggggaacagagttactgtgggaaacaaaaaattgacaagtggtcaagatcagaaaaggtgagaaatgccatgaaaaagaagactgttgcgttcatacttctctcttgtttttctcctgtttcatcactcagctccgtggtagtgattgactctgattctgatgaggaatgtcacacccatgaagagaagaaagctaagttattggaaataaacagcgacggcaagtatatattactttgttagataagtagctgagctccaaagcctcatcacacgtggtactttcaggatcagagtccgcagactttctattcagaatccctcagtagtgagtgccaccgtttctttcctcgtatgtgctggctgtggatatggccgggttccctataccccctggtcaatttcccagcagcagcaactgttgttgctgcctcagaccttgggggccccctcagtagagttcttacctgcctagagctatatcagtgaagcggggtaggggtggtgggtcaagagctgaggctaggaagtatggaggctgctctgtgactccctcttcctctcttccccgctctatgtgtgggaatgacgaggaagaggaaaggagtaagaggcctggctcattcttccttccagcttgaagggtggtggttatgggccagctggcagtgtcgtgttgagaaaactctttttccattgagctgctggtctttgctgtttgccggtccttctgtattttctacagattcttgtgtttctttagag

SEQ ID NO: 137806 - DNA, 1007 bp, Homo sapiens
aggctacaaatgaaggcttgggaaatgccctgatctaaggagctggatggaagagggagcaacatgttttcagggtctcttgacgagacgcttaggtgtgcattccttctctctctttagctacataaacctcagttgaatttatctttgcaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaaggtaggatcaatgaatgagcactgattgagcacctgctatacaccagtactcttggtgctgtgaggtgtgctaaccatgtatacttcctgcccttgagcagaggcagttaaggttgggagatgagccctggtacaggtgaaagcaatagagaatgtgtatgagttataatgtataggacagatggctgttaccacaggagatcagcagagggagaaatcactaagagcctcaacagccaggaagtaagattacctggaggaagtgagactctgcttcttaaaggatggtaagtggcaaacaggatgggggagagggagagttgaggctcgacaatcaggaagagaggattcttgtggaaggataatggaaaagagctgtgtgaccttgaacaagttacttgacttcagtttgcctcagtttcttcatctgtaaaatggggacaacacagtacgtattacctcataggattattgttacccttacataagttaatacacatacagtgcctagaacagggcctaggacatagtaagctcttattttttgatagtgtaggactggataccagagggccttgggaatcaggttggaggaggtgaaatttacatcagtaggcaccactgcacagggatggggtgcatcagggagtgaatgaaattaacctgctgaaagaaattaacctgacactaacctgtgggtatggactgga

SEQ ID NO: 137807 - DNA, 1053 bp, Homo sapiens
tggccctccgagggcctggctgtggctgccccactgctggtgtccaacccggagtcacaacgctagggggccacaggtgcagatgggctcatactggggaacagggaagacagtcacagagggagggttggagatgctgggcagagcaggggcaacatgttgccagcagagggtgatggtgcctcactttagaccctgctaggccttttccacctcactgggcggcttggaagctggattttgtgttctctttcaggtgactggcagccacctgtccatcccccaagaccggaaaggcagcaatagcccccgggagcccagggctgtcctcgggtaatgttttgtgtggctcctagaaatccaggtccacactagatggtgggatctgtgtctaggttaaactgatagctgcataccccccgacccccgccgcctccaccttctgcaccccagggagagagggtgcctcctttccattgaggattctgtgccaacccacctcgccactgggctgcaggctatgggggctactaagggttgggggagacagggaggacagggagagaggaggccagaattgactaaccatttatcttcctctggtgtctcctggactagtgcatccggctgcagagggaaattgaggaccttagagaccaactaggtatgagggagccctggctggggcagggatggacagcagtgtctttctgcaggtgccgggggcagggtggactgtaggtacaggcggcatcactgggactgactttcctttggggaagagaaccaagcaggcctggccctggagccttctgtgcctttccagctaggggtgtgcacagacagcaatgtgttgtctgaactccatgtacacttagtccacgagtcccagaactctcctcttacgacggttagagatacctcatgtgttttccctacaagcctggtagggcttgtatggtgtttgcttgctggctggcttatctgtctttgaaacacgttctgaaaggttctgggatgccccagcacctgagaaccactttcctgcttaga

SEQ ID NO: 137808 - DNA, 1043 bp, Homo sapiens
taccactatcagggaggagattttgttcaatgcactgagttgggataggatctgatggagggctttctagtggattgcaagagattcagcaggaacatatccaatgagattaaaaaaagagttaaaatgtctgggggggcacagggagaaaaaacaggaaattgagttttctctgtgaaattaactagcatttttgcctttctttctaatttatgaagctcttttacatttgttatctcatgtgattcccatgacaaccctgtgagttattacttctatttgagaaatgaaaaaaatagactcagagatattaaaactgacctgcccacagtggcaagtgggaagtgaaaaccaagaaaccatttgcactgttttaggtggtggagatacaggagtgaacaagagaggccaaaatatttgtcctcgtggaacttactaggtagataaactatgacttatttcttttcaattaccctctgtcaagtaatagatactggttttggttttcaaccttaactgtattttagaatcaccgggcacactttgaacaaaacattgatgtgtgtgtgtgcacacacactcaaattttaaacctgctctcgggggttttagtgtgcaatcaagctcaagaaccgttggtttagagcagtggttttcaaccttggctgttcattaaaatcaccttgagaatatacatatatatacatacaccaatgtctgggctttacctctgaggctaattaaattaaaatctctgtggttgtgtccagacatgtgtacttttaaaatgtgcctcctcaaatggtgctactaagttcagggtgtggggtttacatgaagcacttgagataaagaatagcttggtcccatttcacagactgtgcccctcacctcttgagcatatgaatcatcggtccttcattcttgcaacaaaatgtttattgagtacctgctgtatctctggtgagttccttctctttcctgggtcctgattcctccctttgtaaaatgagagactggggtgtctctgagacttattgcag

SEQ ID NO: 137809 - DNA, 1027 bp, Homo sapiens
ttgtggacatccactgctccttagtgcctaaagctggcaacctcatatgctggccgcaggactactgggctggagaggcagataccaacccatctgtgccctggcgacactccgctatttgcctttgcaagagaagttcacaccgaggagtgactgctggagacaattaccaccacagtggtgacctggcctttcagtttcttaccctgaactcctctgatttactctctccatcattcatacacccatttttatcaagatatcactctttaaatctctgttgggagcacaacctctctcctcccacagcttcccagcacacctgcagtatggtctcttggcttttgcccaaacatttgtattttagacactgcttctccacaccccacacttgtctctccgtctctctcttcctttcccctctctccccatcagtaaatgctttcaattgcttctctaaagagcctataccccgtgataccctcctttccttgaccttagacccttcttattatgacaattattatctccaggcccattccctgccccttcccctggctgttttctctcctcctcctgttggctctgagcttgctttctttatagtgatggtactttttttctctcccaaactagctccttcctcatcaccattcctcccagcatcctggtttgcagcagtcaggtgaaagagagaagcaggtcccggagggtcttggggcatgtccctctctgtctcagggagaaagctgctgctggccctaccactagtatcctgtgagaataacagcccagtgctgccagaacctataggtcttcaagagaagatagaaactccagattttaatgtaaactgtctcacttttaaatgttgaaaactattctttttttccccaagaacctggggaaagtagcaaaaccccccacatctctgggctagatttaactcccctatctcccacattaactcagttgcccagttctggaaagctgcctgctaaggacatatcctccatttcactggccc

SEQ ID NO: 137810 - DNA, 1512 bp, Homo sapiens
gttggttccaggagccacagcccttcctcacagccaggctgctggggctggaatgggctgctgagctagcaccacctgcccggtgtcgcttatcccagagggctgcagcactcacagtgagcggctgcgtaagtgtgtccgtgtgtgtgtgcgtgtgtgtgtgtgtgagagagagagagagagagagagagcgcatgtatttgctgtgggactcatggaaggagccctctcattggctgccaagggtcccagttccagtctgtgaatctctgggctgccagctctgccctcccctgggaaggcaaagcaggagagggaggggagagtggagtgaggcttcaggtgtgtctgacaaggaagcaggtacacctggtggccacactgggcattcttgtggcatctggctgtgctagctccaagtctgcagcctgacagctttgtgctctgcccaaattttcccagatttctgttgggactggagcccagagctcattggcagctgtcacttacagaactggatccatcccccagtggagcagggagctgtgtcacttagaattcctgggtagcacattccttcagtagaccctgtcacactcctggattaggctctgttattggccccgcgctcctgcaagcttctgcagacagagtgagcgagtgagcgagtgagtgagccagcgagcggcagcaggaatgacagcactgagagcagagacagccagggacggtgagggcgggcgagtcgggtcccggggggtgcctgtgctggccctttctgcagaggcagatgaagtgggggccactttcagggcttgctagggtttctcttggaacctgggctgctcgacccgagtggagcactgagcaagggggagggggaaagggagggggagagagagggaggaagagagagagagagagactgagagagactgagagaagctcctagcaggctctagtccaagtgagaggctcagatctgtacaattctgtgccaggggcacaagtgggatttggaagagccatgtgtgtgagaagcaaagctgaggtgatgtaagcacctggggaggagcacaggcagaggaggaggaggaggagtaggaggaggaggaggagaaagaggaggaggaggaggtggcagcggccgccgcggtggctgccagtccagagcagaatgatgggcaactctcaccacaagcaaccgaggagtaaaagccaaagcaggatgcattcagcaacaggtactcttttcccttccctccttttccggggctcctacagccagggcctcccagctgctgccatgcggggcccctgacccttggcgtgacttgcaggggctggcagggggcagggagagaacccgagggaaatgagggtgaacttccagctcccctgctcctgtgacaggctgaattgcataagtcagagcatcctgagctgggaggggccagccccttcgccggcaaccctgtgtagcctctggagggtggctggagtgtcagagaa

SEQ ID NO: 137811 - DNA, 1041 bp, Homo sapiens
catcactatacagcatacgcatagctgtgcatatatggaccagctgtttgaactagcatcccatagagaagagaaagagagttaatatccatcatgcacctattatatgccagcacttttcatccacaactttacttagctcagagaaaccaccaggcagggattattgatgccattttacagataagaaaactgagacactaagggagagctgccccatgatccaataacaaggaagttgtagagccaggatttgagcccaaatctgcctaattctcaagcctgtgcctattgcaccataccatgtgcttctcagcatctttgcatctgtgacaggcattagtaaccctggagactggatgtggtggaaggaggggtctgggcttgcttgtggtagggctagcaaatctctatggcaacaagggctgcaatgcccagccttgtagaagtcccaccacatatcgtttgatggcatatttgtattattggaataactgaactcattggggactccatgctgggtccagaagctagagccagggattcctgaggtaataagaaagtagaggattcttgaatttaagcctaaaccaggttaggctgagagaggcttcagatccagacgactggtatcatgctggtttccaacatccctctccccgcaagcaaccgaatcagcactgtaaatacggtggcctgtgcttcaggatgaaaatgagtccaccattctcttctctgtacctaaacaaaatgaggaaatcatctcattacatttgcaaggcatttttatagttgacctggctctttcatcttcacaagtttattgaattctcacatcctcgatttcagtatggtggaagctaaaatggcagagacttataagggagtccattgacccctatccccctgggagcttcttcctaaagacctattttctagtcagacttaatgagtccattggaaggtatggaagaagttaaaattctaggccaccgaacaaaatatttcctggtgccctcctcccatgactgagagatgtgt

SEQ ID NO: 137812 - DNA, 1088 bp, Homo sapiens
aggaaagtccctgggcacccactgaggagcctagggacagggtttgggacagtgtggagcccgtcggctccctgcccccagtgtgggctcagcacacacttttctcatgtggattcttggttatccacaccgctgggatggagagaactgactctgtcaccctcttctggatccggggaggtgagtcgttgggggaagaagggtgcatgctcagcagaggggaaaagggaaggaactggggctcatggaggaggaggagctttctgcactcacagctatgctgaggcagcctgggctgctttgggagggagtgggactgcgttctagaggtgtgcacagaggggcaggatggccacttaaccgagatcctctgaagggaattcataatcggatggctttggaagacagggtggatgtgatcacatcccaaccctgatattctgggatcctaaaggattaataaaagtgatggaggaattctgcacgtgtgtgtgtgtgtgtgtgtgtgtgtgtgtgtaagaattactgcacctcttacttcctctactcttgtcccagattctgaggccttgtcccttcggtggtagaaaattccatctcattcaatccatctcattcaatcttggggctttatttgcctcctggactcctgctaaaatgctgaatttatttttgcaataccaaggcatgtaggcaaggagaggcaggaaaggggttcctgtcactggtcttctgtacacacaggttgctaccaagggaccaagagctttctaattgcagttcaagccagacctcctggcagtaaggcagaagcaagtacagggccctgtgccacactaggacccctctctggcttctgtgaagaagactagccacgtggtggtgggggagggggcgcgtgatgccacagtgacatgcccttgaaaatgtctggaagctactgcttgtggaggtagctggcaggacagactgagtccatgctgtgtctctggagttttagttggccctttgcatcaggcgtatgctcaaaagcagtttatgagctaaagtggtgacgggaccaaaaccgaagtcccatgaggaccacg

SEQ ID NO: 137813 - DNA, 1046 bp, Homo sapiens
ctgcgtggggcctcaggaggcaaagctgaggtctgtagacaaggaggaactttccaacagaccctccatgggtgcagtggcctgccttgaaaaggagccaagggtcttggtaacttttgcaggttacttttttcacagagacacagagtgagccctagagaagaagggcatgtaggagcgagctttctgcttctgagggagagagaatgggaaggaggggccaccctcacctgggatgaaggcccaacacccccctgacctccaccttcacaacttctcacctggtttggcctccctcatctctctccctcctatggggctccctgcttccactctccagcccattctccactctgcagcatgagcgagcctttaaaaaacagacgcagctgctcaaaatcctgtgatggcctcccatggcccactggtgaaagtccggatttatttctcttctctattgcctcctttctactctctaaaaacagagctgagataagatcgtttctcactctaacacagctctgacatttcataaatctttgtcctagacaactggaaagggctatatttaaccttccgtcctgtagcttttaatggagggacttgcttcaggcactgccttctaatgccacaggagaccagagtttttctttgttctctaccagcagagccgcgacctcgacagacagaggccacagctggcctctccctccagtgagacgcacaagttgcttggccaggcatcggccctagagcatccaccttcccctgtctctaggtgaaggaggtccctgtcccaccctgtgaagtgtgacccttcaactttcttatctgcatatacttgaaagactcctcattaaccccatagctgagataagtgggccaggtgagcacaagaataggtcagacagggcctggaggtatgggcttgggagtctgggctaggggagggagccagagagaagaaaatgtatggtcaggaatctggttgcgcagggtgcaggggcgagggtggggaaggaagcaatgctaagtaatgtaccagg

SEQ ID NO: 137814 - DNA, 1370 bp, Homo sapiens
cctgttttccagaagctggagagcttttttcctttctccaaccgctatagttctcttttcaaaacacttaaaccctcttagtgatttttaactgcaggtggcaattaaattggtttcccaaacatggaccaaaccttctctccagtgcctcctgcatttaccctgcctccacccacccttgaaccaggaaagaaaaaaacacacagacacaatttactgagttattgtcctctcttctgtgtagccctctcttaacatgaatgtggcaaaattgctaggaagaaatggtaggatgtatttccactaggtaggtctctttctccacagcggccatctttgattattgtgtctggaatcgagcagtacccaaccaacatggtgcccttcctcaggctcttccttggcgggaagacagaggcagcagttgagcaaggggagccaacagaagtggaatggctcctcattcatagacccttgtgggttttgaaggagagaggaaagagaaggtttggaaagaataggacagaaagggaggaataagaaagaggaagttggccgggcgcggtggctcacgcctgtaatcccagcactttgggaagccgagacgggtggatcacgaggtcaggagaccgagaccatcctggctaacacggtgaaaccccgtctctactaaaaatacaaaaaaattagccgggcgtggtggcgggcgcctgtagtcccagctactcagctggctgaggcaggagaatggcgtgaacccgggagacggagcttgcagtgagcgaagattgcgccactgcaccccagcctgggtgacagagcaagactccgtctcaaaaaaaaaaaaaaaagaaagagagaagaagttgaaaggggtgtttacaagtggaggaatagaaataaagctatgaattgaataatagaaactctgatttttaaaattttattttatttattttttattttaatagttttatgttacgtaaaccattatatgttatttttaaatatatgaaaataaatatatttaatggtttgttattgtaaaatgacacgtttgttgttaaaatttcaaatagtactggagagtttcaagtgaaacatacatgtcaaaatcatctagaataacagttacttgtgtgtccttgcaaacttattccgtgcatatataagcatctgtgtgcttttgatacacaaatgagatcatacaatacatactggcccattccttgcccatttttttcaacttaccaataactctgcagttttctagtttctactcaaagagatatccttcattcttcttaatggctgcatatcatccccttgtgtagatgcaccatgatgtgtggaacccatcccttgttaat

SEQ ID NO: 137815 - DNA, 1032 bp, Homo sapiens
ggcagagccagggttcaaagccaggtctatgtgactctcaagcccagtggaggtcactctttagcacactactgagaggaggtgatgtccctcagagaaatggaagccatcaacagggtgctcgctgggaaggagcaactctgcaagttcctgctttgtctcccctgctttccctactgtccacacctccaaccttatctggggggctcctagctccacgtgcataccatcagtcctcagtcaggtctcagggggccagtcctctttccaaaggccattgccaatgcagccttcatctgcaaagaggacaagtccatgttctcccactgaaccacagtcttgcagtaacaaattcactttggagtcatggaccagcctctgctcccaagtagatctcaagcctcacaggccagtggggtcggggttagagggcctgaggggaactcagaagggcaggggcttgtctggggagtggaggcagtttcgcggaggaagtggtcttggaactgaggagaacattgccagttggagtgaggccaggaatgttcatgaatttttaagggaaagggaatggagtgtgcaaaggcccagaggcatgcaagggcctcgtatgtacagaaaagcaggaagtaattcaagatgtctgaaatttgggctaagtagaagaggaaagaaggatagcataggcagatgagatggcatagataattaatgagcagatagggaagaaaatgccaaaagcaggtctacaagtcttcccacgaggaaggagagccattgaggggttttgtagaggagcagcaaggccaggtgtgtgaattcaaaggcccacggcccccacccccaggcatgttgaaggtggacctattagaacaggtagagactagagcctgcttcagtagctcaggtgagagaggaggaagggctgaactgtgggtggagaggtcatcaatttggggacactctttctggcaagcctcacagccaacaggcctcatctgtatgatgcaagaggtgaaggagaccacagtc

SEQ ID NO: 137816 - DNA, 1040 bp, Homo sapiens
agtcaagtaaataaatcaaagccccaggtagttgtagaaaacacttcctcagactccacaggctcccctctgagattcaaataggttccactctcacccactgggtgggagtcactagtttagatcactcccagctccttcatttggagaaatgatatacagtgtttaaaacaagagaatgctcgggccacctgttataatgacaaagacatgacagaatagggacccacgctgatcttcaccactcactccaccttgggcaaatcattaagcttctgaacttcatattcctcctctgcaaaatggaggtattaaaaatctccaccctgctgccctcacagagttgctttcaccatcaaatgaaataacatatgagaatgtgctttgtcctatctactgtggtcaaagtcattccttttggttttttatgtctagggagttctgtggaaccaggcaccgaagaaaaaagtttaatcagtgataaaacagctgaatggattgcagaggatgatgatgacgtgtttgtggcttcacgcacaactgaagatttatttactgtgatacacaggtctgcaccaatttccttaattctaattgcaattgccttccctttttgtacttaaagaaaacctgctattccacattgaaatcctaattgtaaaagaaaaagaaaaaaattaaaaataagaaaaactgctacctttaagcagccattagaattgcacctggaggctaagttcagatacccacatatgtgagcgcagtccagggcctcgcatctcaaattcactgacatcgttgggtaaagtggaggaagggaggggagaggaggaccaggtgccgagtgagaggcccctcgtctcctagcaaccacttggcctattgtggctccatctgctctctcttagctctgtctatagtcagagacatttaacccttcacagaattccttgtatcaaaaaaatcccatcaagagttgaagtggggcaccaggcagcatatcaaaacaggaacttaggaaaagaggaaccagatgggga

SEQ ID NO: 137817 - DNA, 1103 bp, Homo sapiens
acaacagagcctacatttcttttatattaactcacactctggacagcaggagagaggctacttcatctagagctaaaatcatctggcacttaatcatcttcagacatttttatgttttcatacttataagcttgtcatgactgactaccgagtttcttcttattttcccccagtggtgtgcactaactaagaagaaattttcagatgtcagggcacatgtgccactttttcaattcagtgacccggctgctccatccctggctcctgtcactgaggagtgcagtgtgagagcagattggaggctgccaaacttggggggcatagggtgccattgcttattattcactttcctagggaggctctgatggccctgtgtgcaaacacagaaagactctgatgcctcctcaaccacagtttagctttcccctgcgctcacaagaggtttgcagggtgcacttatttcggcatgaggttgattggatggcttttgtggtgcaaaatatgactgtgactctgtcctgaaacttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttg

SEQ ID NO: 137818 - DNA, 1948 bp, Homo sapiens
aggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaagaggatttggggcagaaatcatatggtcagagagaacatttaagaccggaagtattcatttaattttttaaattaattttttgtaaagatgggggttttgctatgttgcccacgctggtcttgaactcctgagctcaagcgatcctctcgccttggcctcccaaagtgctgggattaaaggagtaagccactgcacctggcctcatttaatattttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcg

SEQ ID NO: 137819 - DNA, 1037 bp, Homo sapiens
ggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgt

SEQ ID NO: 137820 - DNA, 1117 bp, Homo sapiens
gggttaaatttgtttttataaagccttttattttgagataattatagattcacatgcagttttaagaaataatacatctagctgggcatggtcgtgtgtgcctgtagtcccagctacttgggaggctgaggtaggaggattgtttgagcccaggagtttgaggcggcagtgagtcaggatcacgccactgcactccaacctgggcaacagaatgagaccttgtctctaaaaaagaaaaaaagaaaaaggaaaagaaataatacgtattcctttgtttctcccaatggtaacacctaacaaaactatagtacaatagcacaaacaggatattgacattgatgtagtcaagatacagacaatcctaccactacaaggatccctcctcttggccttttataactatacccgcttccctcctgccccacctctgccctcttaacccatggcagcaacttatctgttctccatttgtgtaactttataatgtcaagaatgttatatgaatggaataatacagtatgtaaccttttgggattggttttattcacccagtataattcgctggagatttcattcaggtggttttgtttatcaatagtttattcctctgtattgctaaatagtaccagttgagtatccctaatccaaaaatacaaaatacaaaatgctgtaagatctgaaactttttgagcgctgacatgacactcaaagtaaatgctcattatagcatttcagattttgaattttcagattagggatgctcaactggtaagtttaatgcaaatattcccaaatccgaaacactctggtcccaagcattttggataaatgatattcaacctgtatcccatgatgtggaagtgctgtagtatgtcgaaccattcacctgttgaaggacagctgggttgtttcaagtgttttttgaaggcaccagtcggtgagggaccctgggaccctctggccttttagggttcagctcctttcacattctgtcattctgcttcagaccccacccctgtgcccacaccctgcccttttgtcgctataagctctgcagattctgagacccatccactgaccacagcttccctccttccccttcccttcctgcctccgc

SEQ ID NO: 137821 - DNA, 2280 bp, Homo sapiens
tcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaggaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaag

SEQ ID NO: 137822 - DNA, 3634 bp, Homo sapiens
ggattacaggcgtagaatcatctgtacgtgagactggaagtaagctcactttgaactctccttgaggccagggatgttgtgtagctcatctttgtattcccagcacctagcacagaataaggcacacaagaggcgctcagcaaatatgggaggaggaagggcggaaaaaggggagggaggaaatcgcccttaggagacaccctctttccgcggcggttcctcaactcgggacttctgacctcccaccagcagatggcaagaaagagtcccggcgcgccagcaaagggctgagctgggcggagcagctgaaaatccggcgcgcgcagtctccagccccaatttctacgcgcaccggaagacggaggtcctctttccttgcctaacgcagccatggtaagccgtttagttagcgagctcttaggacgtatccgcctccatcctcccccggccggggctgcccgaggtttcgggattcctactggggatggccgggcagaggcgaagggatcacggcctccgtggtaggccgggacgggctccagggcgaagggcgaacgctggcctagggttggggaggcgcagatctggtgctgctgttgggaaggcctcggtttctgacccggccatacgtcctgatcccgggagaagctgcttttcctcccgggccggagccgcggctgggccaggagctcagactgcgagcccgaggttggtgggcgctgggggtgcccggcggagaaaggttttctttgtcattgcctttttggcacggcctgactttaccatacgtggccggtaagcatctggacacagcattaaaaaggcttccttactctttttaaagtaaaattggtgtcagcttttggctttagtgtacgaaggagcagcacatgtgtttgtgcggatgtcagaatcttgttccatacgtgtcaaaaacagacggtaataaattgtgaaaactttagaaacacaggtagactcctggctcatttctgttgctgtgcgtttcactagtatggtgttcttgaaagaccctaacctctaagcagatacagtttcaaacagtaacatggaaacactttagcaaggttctgaaagatagtaatcagtaaacgttctgaaacatagtaaccaagaatattctctgttacaataagaaggcttgttgcagcttatggatctcacggtgtttgttaaataactgtgtttgtttctgttttatcggaacactatactttaatattgtccacattttgctgaagatgaaactaaactaagagtttagtttcacactaggttttataagctgttctgaaacctgattaacagcattgcaatctaaaactttcaggctcgtggtcccaagaagcatctgaagcgggtggcagctccaaagcattggatgctggataaattgaccggtgtgtttgtaagtatcttatataaatatttccgtggccactgtttttaagtgtctcccaggactcatttggggaccaggctaggggaggaatatctattcttggcttcctctgcccttgaaggagctatactatctagctgtcctccacttccaatcgatttaatatttttgtgcctcatttattccacataccacatagtacatttacatggactcaggattcatgttcttaatgatcctggtcctctgacagggaagatgctataaaactttaaggtatgaaatagttttggatgctttttacacctcctgtgtaaaagtccaagttgggtgtaatatggacggtcttggtgttcagttagtggatctggtggactaggaggtaggtttgagtgctttagtgaatcccaacagtgattatcatttttaacgttacaggctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatgggtaagaagttttaaatactctggagacgcatattgatggcagccctatggtatccaaatactgtcttgatcatttttctaacctttgtaatctgtcaagtctcagaaacaaagcctgaccttccctctgttttttacttaaataaaaaacatgcaaataatcatgaaacgcttttcaaaactaaatttcgattcacttttaaattttacatgcagtcatggggttttgaaatattgaagatctggccgtgatctttaatcttcagaatccttgttggattagaactgggaggcacatgggggttctttttgtttcgtagagagctatggttgttgctcggcatgaggtagtggggatcactgtatgtagtaaccggttactgcttgatttcagatgtcatcagcattgacaagacgggagagaatttccgtctgatctatgacaccaagggtcgctttgctgtacatcgtattacacctgaggaggccaaggtgagtgtggcaagcaagctgggtctttactcagtatagttactttgttctaagggcctgcattgagtacgagtgctgcttgcaatgaggtgggtattgattagttaaaatctcatacctggaaatatctagctaacaattcgatgagattctgtcttacatgtaactttttgtcatgttattaaaagtctggctgatagctgtagggcattgatggatacctaaaattggcccccatttgaagttaacttcctcagcagattttctttttttgtggtagaaatgaattccagttgaaccgcgacttcctggtgtctcttaagagtcaaggagaatgatttctgggaacttgtttattgggtacctgacgtaggagccctttgccatgtctccatttgtgggagtagctttactttggggaggggaaggtgtcgatggaggaaacagacagtccttgaggcactagtttgaggtttaaaaaaagattacagtctttgattatttaatccagtttgttttgatggttttacacaaaagtttagggctgtttggattattggctgtaaatgaaggttaatttaattgactgatgtggctcctaatttccttttgcacagccttgttaacagcagactggagggcacgtccagtgggatctgtgattatttgatttacttcaaggatatcagggagtagagatccaaaattgaaatgctatgtgaagtatttgttgattggatgaactggtaatgtaattgctgtttgtgagacaaaactcagtcgtgatgtacagggagccattaagataaagttgagttgaagggaagaattcccagggccccataaggcttaaagagcctgggaaactggagtggcatttacattggaggagtggagggcaatggtggatgttaggaggacgagcctagagaagggctttatgcaacatacacttgagggtggaaagaacgatcagcgtcacaattaatctgcagcagttagggaacccatggttcctgtatagggttaaaaagtacatgtgagatggattgaatgtggctaacccttgtatttttctagtacaagttgtgcaaagtgaga

SEQ ID NO: 137823 - DNA, 1082 bp, Homo sapiens
tgacttgtttcttctttccttccttcctttcattcgtccattcattcagccatttactgagcacctactatgagtgaggcactgtgcaagactttggaaatcaaccaaaagtaagacagccaggccctgccctcagggagcattgtttctgtttcagagaagtggccagtagggtttggagcccagtgtttctacttggggaagtgtggcaaggcaaagactacggagggacaaagtgagcaacttttcattcctagagcccagtccggtaggatttcaaatgatcacttttccctcaaagactcttaggcctgagatcagaggaaagcccccaatccgtgtttcacaggtactcacaagagaaaatgctaggagggttgtgccttgctaagggaaggaagaaaagttgggggtggggagcatgagatttgatgcagttagtaaagaatgaactctgaaaagtgttacgagagagagagagagacttaaaacaaccatttgtttagctcatgactctatagattggcaattgagctgagttcagctgggtggctcttctggttctggctggatacacccagcatctgcagtcagctggctgtcaaaggcctcgatcacatgtccagtaattggctggtggttgcctgggtgacagggatctctgggccatttgtttctcatcatccagcaagctattctggtcttgttccttatggcgaggtcacagagttcccaagagcagcagagaataagccccaaaatataagtgctttttaaaaaatagctctattggggtataattcacatacattacctgactttgaattttgttttctcccctgtttgcagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaag

SEQ ID NO: 137824 - DNA, 1404 bp, Homo sapiens
agcaatgcagctgaagtgcctagagacgggccataaaatggaaacatcaaagtgattaaatgtgcccgaagagcataattgagtgcatgaataagagaaaataaaacaaattgattttctccagtgccagaaaaacagaataattgaaaacaaaataatagactttgaagtaatcaaagtgaggaatgcaccatagtgacatagaaacagccagttgtgggagagatttattgtgtttctgttatcatttttacaactttaatttcattagctaataaatacaaatcaattgaaaaatcagtcaaccagagagacggcagtcccaagccaagatttttattcacatctctaaaacaggctgaggtggtgattcttaatctactttcataggtgcacatttctgccatgagctggaaaacaagttctgggaggtctgtctgctttggaggtggtgatgttctgttctgacagtcactttccacatatagacttacagattcaactttcaaaagggtcacttttataccccgccaaaatttctgacagagaactacccaagtacaagcatcttggtttacatagatgacattttcatggcactgaccagcaactgtggtcttacacaaggtcatcctggattcatttggtgatagtggtggtggtggcagctatggcagcaacaatagcaggagcacctgctgctctcacaatactgctgagcatctatggctcactgcttccaacccccaccctcatcccctgacacatacgtgcacactagtgacactgaaatctaatctaaaaccaggaaggccagtcaagagtataccactcttttggcttccagcctggtgaccatgatcctggggaagatcacaggaggggagctgggccagaggagacttctcatgttcactatggcaataaggaactggggacaccaagccatgctgggctcacatgctgaatgatcacagagcaatcatgagaccaccacagaaccatttttatggctcctccaagaaaagaatccctctaccccactcttcagctgttcacggctgggctcagtgacccttcacttcaggatccacagtgatagctaatgtgacttgaattgtgggttttcctttcacaggcccttgagctctctggcagctgttggcacttctagatgtttgtgacacaccctaccttcagggctccacagttagcgactgtttctttggctccagtaaaggtctttgggaccattgggactgtaaaccagggtgtgcagaaggagttggcagtgctgagactggcattacttgttggctcagtcaggatggcatagttaatagattgtgcctgccaggcaatttgtcctggagaatttatcttccaggaagcacctagaagctg

SEQ ID NO: 137825 - DNA, 1030 bp, Homo sapiens
tggggagtaaaagtctaggttccctactcagccaccattgacaccctggggagaagaagggcacctcagtattgctgggtggagtagaattcaggctctccaatagacctccactgataccactctggccaaaaatgggagcggcacctttttattgctccgcatttggcctctactgacatagcagtgggtgggcctccttgccattaagcaaagatggaaagtcctgactttctactctgccttctttgacaccaccctggtggaatggaagggaagcctaacagtaaccatttagtgttaatatgtgccaggcactattctgggcactggcaatacataattaaatagaatagataagccaggcacagtgatgtgggctgatagttccaaatacttaggaagctgaggaaggaggatcgcttgagcccaggagtttgagaccagcctggacaacatagtgagaccctgtctcttaaaataataaaggaaataggtcaaataaagtccttgcccatcatggagattacattctagtgtggaagatagacaataaacaactaaataaaaatttaatgttgtttactgataaattctgagggatgctattcagtaaagacctctcggaggaggtgacatttgggaacagagattaatgaaatgagggaaggagatttacaaaatttgagttcggccgggcatggtagctcacgcctgtaatcccagcattttgagaggccgagacaggcagatcacttgagcccaggagttggagaccagcctgggcaacatggcaaaaccctgtctctaccaaaaaaaatgtaaaactgagctgggtgtgatgacatatacctgtagtcccaactacttgggaggctgagatgtgaggatcaattgagcccaggaggtcaaggctgccgtgagccatgattgcactactgcactccagcttgggcaatagagtgagaccctgtcttaaaaaaaaaaaatggtagtgaagtacattctagatgaagagacaagcaatatc

SEQ ID NO: 137826 - DNA, 1079 bp, Homo sapiens
aatctgaagcttctagctccctttccctagtagagaaggaaaagaaatggacagaaggtaggagaagccagctcacccagctcctgctgcctgaaatgtgctgtagccaccagacccagtctgccatttgcagttccacagccccaatctgagaccctttgcacatctactggtaatattcttaggagaaccattgtgctgcgtataagcagcacttcctctggcagcctgacatccgggattggcatccttctaggggctagcaattggagctcaggtttgcgcatattcaaggcctgctggagccccaggcttgaagcagtgctcctgcatggtgggactctataccatggaaacttggcttccttccacactgtctctttcttcttgagaagccatgaggataagttgaaaggtagggttggtcccaaggataaactgaccatttgctttagggcttcttggaaggacttcagagtagggttttggaggatacctgagccaatttgcatgacttcaggtgaaaatctctgtgatgtccatcctttatctctctttcctgtcccctgctggctctttattcctcttcatctccctgtggtcctttccaggagcctactgccagcttgggcttcttcatcaagcaagttcctctctttcttgtttcactaaagagtataagagatggaaaggcttcttgtcatcgttgttattgctgttgttaaacagaaaaataagttacaaaaatgtcatgctgaaaattttaaaaattctgggccgggcgccatggctcgagcttgtaatccagcactttgggagactgaggcaggtggattgcttgagccgaggagttcaagaccagcctggacaacatggtgaaaccccatctctacaaaaaaaatacaaaaattagccggatgtggttgtatatacctgtagtaccagctacattggaagctgaggtgggaggattgcttaaccccagggaggttgaggctgcagtgagctgtgactgtgccactgcactccagcctaggtgacagagccagaccctatctacaaaaaaaaattttttttaa

SEQ ID NO: 137827 - DNA, 1124 bp, Homo sapiens
ctcagaactgatcctggaccggcttctcttacccttcttccttcaactctgccattttcccccatccaggctctaaatcctggtagagcacagacaaagcaatagaaacagggaaaccaagcaagccttgcagctactcgctcacacctccatatgtgcagatatgtgtatgcccttgcttccctgcacacatacccagggacatagctccagagagtggtggcatcttgctattgaggaaatggaaatgacaagtgagagaagacataaggaaggtaatgcaaagggaagagaacgaggaaaggtaagaaccctaaaagagcagaaaatcaaaaagagatttgagataaaaggctaggacgagggttggtgaaaaaaataacagatctcaaaggacatgaaaattacatggaagtcaagctttttaaagatcctaacaggttaaagcaatattctgattgtaacccaatgaaatcaaactggaggaaaacatatggaccagaaattgggtcctacaaaagcaactacatgcatgcaaactggggcaacatggcttagcagcattttgctaaaagagaattagggatttgagtcaactcggagctcagtatgagtcaccagggcaaggtggcctccagagatgctaatgcagtatcgacctcattttaaagggctctagacaaataggagcatgttcctggaggtcagtcaggctggggagaggactggagcccaggctccaaaaggtctggttggaggtgctggaaccttttggagaagacctcggggatgtggtctctacttcatatatctgtcacagtgcaaagggcatagacagggtctatgtggccacaaggcatagagctggacccatggatggatattttaaaaaggcagattttcattcaatagaaggaagacattttctaacaattagaactatccaaagtggaacagactgcctagaaaggcatgaggtctctgtcactggagatatacaaatagaagctagacaatccctaggctgtcatattgtagaagggccccttccttgggggagggtgattggactaaattgctgttaaggctccttccaaccctaagattctaggatgctgtatatt

SEQ ID NO: 137828 - DNA, 1028 bp, Homo sapiens
catttgcccccttttcagtaccatgttccccctcaaaagtgcataaactgaagcccagaaagcaaaagaagtgctgagggggaaaggggaaggggtggagagaggttagcacctccctctttccttcagtgagatcaaagccagcattttcccttgaaggtcagctggcctctttcatcccctgctccacctgtctgggaatgggattgctgcttgcccatttcctttcctcttcggggctggaggggcctcaagctatttctagttctagccaaatccctccactccaacatctcttttgccttacgtgatcatatttcctttccacctcgccagtaagtaacaagtggcaggaccatagggcagaaaactatgagagaagtcagtttctccacaggctagtcagtttctcctaggctaagctaatggcttaagcaagcggggagggacactgaggctgctgggcttggtctggcaggaagaacagactcatctttctacatctcggccctaagcgcttcacctgacatccttcagggtgtggatgaggcttggttaggcaagggcctcttgccccaggagaagggaattcacatttattgaagtcctagtatgtgctgggccctatgctaggcccttttatagatattatctcattggctcctaacagcccaaccaggtcagcatttgtcatcgtcaggtggaaatgatgaaacagagattaaaaagcttacctgatgacaggtacactaaaatctcagaattcaccactatataattcatccatgtaaccaaaaactacttgtacccccaaaagctattgacatttaaaaaattttttttaaatgaagcttacctgagacacacaagctaaatccaggcaccaaaatctagctcccccaactctaaagccagtgctctttccacttcatcatgctgcctcaagagtctagaaaaactgttaatgctatgaattgattctttgaattatttcacacaattagctatatggctagctaaacccttgg

SEQ ID NO: 137829 - DNA, 1037 bp, Homo sapiens
attattaattttgttgagtttgataatggtattgtgtttatgttaagaaaaggtccttatctgttagagatacatactaaaatatttatcagctatgaaatggtatgatacctgggatcagctttaaaattcttcagaaaaaaaatgggggatagaataaataggaatagtaatattggcaattgttgaagctgggtgatgggtacatgggggttcattatactcttctctctgctttatttatgtttgaaagttcccgtaatgaaaagttaaaaaagtaatataccctagattactctggaagtgagtcatacattagtgaaaattagtttgagcatgctaacaacatctagtagactcggacagctaccaggaatgagattttggatgggcagagccaggaaggagggcaggtgtatgttggaacatgagccacttttgggaactaggaagtcctggatgcggtggagaaatatttgtgagggatggggaattttgaatggtcagacaacagtctgaaagttctaggagagaaagcaggaagtgaaagaagagaggagacagagtgcaataggcactcatgttcatgtattaggtctctcgctaagcctataagttcctggaagttgggtcctgtatcttaatcatcactgtcttccctagagctctcaggacattagtttattgattttatttcattcattcatttatttaagaatacttattgagtgcctatgaatgcaggcaatccaaacatgtgtatgcagtagtcaaaggagatatagcagtgaacaaaacaaagtctctgccttcagggagctcacattttagtgggaggggacagatagtaaataaacaagcatgtacatgtcagatggtgataagtgctgcagaggaaaataaagtagggtaaggggttggggaatgctgggtaattagttgctcaggaccaaacttgaatggcacttgggcccttaggagctttttcaggtcccctctgccacctggcttttggtcatgttggactctgtgccgtt

SEQ ID NO: 137830 - DNA, 1040 bp, Homo sapiens
cagagtttttaagcagaggagtaatataatctaactgagatttttcaaagatgatgctgactgttgtgtggagaccatattgtactgggacaagagaccactatataggctaatccagtagtccagataggaacagatgtggccctggactagggtagtggcaaggaaggtggtgagagtgattcaagaaacatttttgcagtagaattgacagatctatgactcttttgaatgtggaacctctttgttttactgctgaggaaactaaggcacagagaggccaggttgataagaggtcatttttgtattataattgaatgctgatttcccaaccactgatttcatcttctttctctgcacctactctacttttcataatctttagaaattcccactacctttgtgtcttctcccatatgggatcatcagccacatccagcctggtccttttgtacagctccctaaatctgcctctgcttgccatgcccagtctgctctgggttattgtgactgctctctggctggcctcattgcctcctcccagctctcagaacaggtcatttttttatggcttcactttaacggtgtttccaatcacccttcagcaactctctactcactaaaatgaaaatccagacttggacagtggcttcatagcacttcctcagctagctccacccagaccttcctgtttgcccttgtctcccattgttcccattgtaacctagctcacaccttcaatctttagcctttgtagctcagtaaagtcagagctacccctcccatctctgaaagtttaagccagctcccttgtgcttaaaattctgtcttcttctgttctttctaattgactagcacagttagatatttgtcctgaatcattttagttattaattcattatttcaacaagtaaagattgaatacctcttttgggctaggcattgtactagccactggggatgaaaaacaatcagtaggacaaggtctctgccctcaaggagcttacagtctgatggaggagacagacctgtaaccaaat

SEQ ID NO: 137831 - DNA, 1006 bp, Homo sapiens
tagacaaccctctccatggtcattcctgaagacacactcacatattttcttttgtctacacagctcactttgcccatcatctaaagcatctgtctgtacagggttacctcaagacagtcatgttacaatttcccacatcatagtttatcttaacatttgtaacaatttagtgaggtcgtttcttgataccttaatatctccatttcccaatatataatgggtaccatggcaggcaggacccattgttctctatttcaaaatttgctcatccaacattgccaaaaataaatttatggctcatttcttaaactttttcacccattttccccatctcataaatacccaaagtacattctaagtgcactatcctaaaggccctacccaaagtgcctgtaggatattatcaaaacctagtctgttgctttagtgcagaagtgtgggtgctacctgaaggcagaaaggaatacctataagcttgtacccagtaccaattgtttgggaaccagaaatctaggctgctacatttcaaagggaagtgagaaaattggagcttatgaaagataaatgactcaataaaatggtatacatacagagcctggcacatagtagcccctcaataaccatttgtaataagaaataagcaaagtatccaaggtctcccaaatagtgagtgacagagtcaaaacttccaagtctagttgtttcccctctaacatgttacctcaaaaatcgtctttaaaaatattttgctttccgtcctactcttaagaagtatttaagaacagaagaaactgtctgtgctcttatttcattgtggactgaaatttgttgacttcagagccaaaataactttccttgaagccttccctaaacctcttcctctgaacacccagagccatttcttggagccatttgttagattaaattctgtcttttattatcatttgtacatccttatcccatatttctagtttcttgaataaaattcttaaagtataaatgtatt

SEQ ID NO: 137832 - DNA, 1116 bp, Homo sapiens
atgggccatttcatgggtcatcaaataaacctcatcaaatttaaaagacagaaatcatacagtgtgtattttctgaccaaaataaaatcaaacaggaaatcgataaaagaaagataacaggataattgccaaacacttagaaactaaagaatgcacttctaaataatacatggatcaaagaggaaatctcaaggaaaatttttaaaatacactaaacaattaaaatgaaaagacaacgtgtcaaaatatgtaggacacacctaaaacagtgctgagagggaaatttatgacactacattcttaattttaaaaagaggatagtctcagatcaataattaaactgcaaccctaataaaatagaaaaagaagggcaaaataaaaccaaagcaagtagaaggaaggttataataatgaacagaaacaaatgagattgaaaacagaataataataaattcaatgaaacaagaagttggttcttcaaaaacatgaaaaaaatttacaaatctctagtaagagtgaccaaaaaaaaaaaaaaaaaaaaaaaaaaaaaaaaaaaacagagaagacacaaatttccaatatcaggaatgaaatgggatcttaccacagcttccacaggtatcaaagcaatactagcaaaatacagcattctatatacataaacttgaccacttagattaaatggactcattcctcaaaagccacaaactaccacaactcaccaaatacgaaataatttgaatggccccgtagctattaaggaaattgaatttgtaatttaaaaactcctcaataaatgaactctccaagcctagatgatttcactgaagaattctaccaaacatttaaagaaaaattcacaacaattctacacaatctttcagaaaatagaagaggaggaaacacttcccaactcactttattaagctagtattatcctgagaccaaaaccagacaaagatagtaccaaaaaaagaaagaccgtatttctgctctcagctttgacatctgaaagacacagcaggcagcatctcagaagcataaaaaacagaacggaagaaataaaactgtccttatctgcaaataacatgattgtgtacatagaaaatctcaagg

SEQ ID NO: 137833 - DNA, 2202 bp, Homo sapiens
agcatcgctgcctagcccaatagcaaaagatagactcgggcactgggaatttaccggctgctttaggcctaatacctcgtcaagttgcaccatttgataaaatcagaggaattaattaaaaaccatattagaaaccttcatataattgctgatttcctgcttatgctctaagcacatgccaaggtagcaaaatgtacagattgaaactggatttcttgtccttttaccattaatgtaaaacatgtctatatttcctgctaggtcacccattggccttataaactttttttataaccaggaaagatactccaagggagaaagagtatccctgtaaggaaatagggtttcttccaaggcaaggaagaaaataatatttccttagaggagtacaacaggacaagggcacaggaaggtgaggagactctgcctcttcaaaggaaattagcagaatgcatggaaaagaagcaaaaaaaaaaaaagaaagaaagaaagaaaggaatcaaacatttattgagcacctactatttaccaggtactttactagttgctttcacaggacttatttcatttaatcctacaataaccttgtgaggaacttatctacgtccataggagagaaaattatgtctcaaagaggttaactggttggcctaaggtcccacagctaccaagtgagtaggataggagagcaagggaagagcagtgaagatgcttggacaagagaggagatctttgtcatttccattttgaaactagagaactggtttcctttaagactcattgtatcagcaggcagtgcttttctattcctggagtgaccttagactggaaggttaattgtcatttttaaaaaggggctagcattctttcctcaccttcagtactcctctcttacctctatgctcattctcttaaatcctccaagctaatctttcagaccactcacttcctcaattaattagaatacatcctctgttctttctactcccttgttggttcattagttcaaacaacaatcatgtattaaatgactactatgtgtcagcattctgccaggcaccaggaaagcaaaagtaaaaaccctattcctgctttggaaagattcataatcggcagggcgcggtggctcacacctgtaatcccagcactttgggaggccgaggcaggcggatcacgaggtcaggagttcgagaccggcctgaccaacgtggtgaaaccccgtctctactgaaaatacaaaaattagccaggtgtggtggcgcatgcctgtaatcccggctactcaggaggctgaggcaggagaatcgcgtgaacctgggaggcggaggttgcagtgagcggagattgcgccactgcactccagcctgggtgacagagcgagactccgtctcaaaaaaaaaagaaggattcataatctaaaggggggccagagacatggaatcattggtttaaatcctattgcaaagggcagtggcagatccaggatttgtaggcctgagcttatgcaattgtacaggcaaggacagggaactatttaagaaaaagaacataaaattttgaatataaaattaggtgcaagttgaaagatattacaaacctcacaaaattcaaaacaattttaacatgtcttattacttaaatgcatgacacatctatagtacttttttcctacatttttttggctgcatgtgctctaatcacctttcatttgaccatgattttgtaatgtcattttcttttttttttaattttattattattatactttaagttttagggtacatgtgcacaatgtgcaggttagttacatatgtatacatgtgccatgttggtgtgctgcacacattaactcgtcatttagcattaggtatatctcctaatgctatccctccccccccccaccccacaacaggccccagagtgtgatgttccccttcctgtgtccatgtgttctcactgttcggttcccacctatgagtgagaacatgcggtgtttggttttatgtccttgagatagtttgctgagaatgatggtttccagcttcatccatgtccctacaaaggacatgaattcatcattttttatggctgcatagtattccatggtgtatatgtgccacattttcttaatccagtctatcattgttggacatttgggttggttccaagtctttgctattgtgaatagtgctgcaataaaca

SEQ ID NO: 137834 - DNA, 1014 bp, Homo sapiens
acctgcaagtgcatgtgaagttggaaaccatggattttggcccatgatactcgtctgtccagtgatacagttttcttcagtagtgacagaacagagaaggcacgttgcgggaggtggtgttgacttggagtggtgatttttccaggtaggtggggcaaaaggtgatgaaggtgatggagaaagagggttcaagtgtgtaatcatgtggtctaggctggttgtgaggccaaaagacagcagacaaacagggagaaggcagggatcaggggattgggtgtctacacgaggtcagaagagcagagatagtggggtgaagagacttggtaggactagcacttggactcagtgtaagacaatagaggcagcgaagtagaaagggcacatgcttttgaaatcaaacacatttgaatttgaattacagctctaatattagttatgtgactttaggtaacttctttgaactctgcgaacttcggtttcttcatctgtaaagtaagtataatgacacctgagtcacagaaaaactaacacatggtcagcttcaatagctgttagtccccttctctcccactcaacatttattgggctcttaatatgaaacattctattttggggacactgagataaaggccaatttacttccttttagtgattcatggtttagcacaagggacacaaagaaataaatggcaatacaagataaacagataaactagtgttcaagttgctaagtacaataatagcagtatgtgctatgagaacccagaagaggtatgactaatagtgcctgagagagtgagggaggctttcctgtaaagctattgacaacccaatttttagtttctaacgctgaaagaaactagtgggaaatgagcagataacattttaaggggaacagcaaagaagcttttgcttttatttttctagacggcgtttcaaggagcaataggttcacaagaaggtgtttatttgttttaaggaaaatgacttgtgatggtttgttaactgaggaga

SEQ ID NO: 137835 - DNA, 1049 bp, Homo sapiens
gccaaaaataaagtttatatagcccctctgctttattgattggatgtttgacttatcaagtcattcagtcattcagtgactatttattgaatactaacaatgtgccagacactgccaagtgctggggctacaatggtgaacagtgtagatgtggtccccatgccatggaacttataatccagtaagaaaggtgcactaaaaaacacgcaaaacataagtcaaaagaattttaacctgtaataagtgccataaaggaagcatatggggagtggagatagaaactatcaaagggatttaaatcaggtctctaagaaaggcctttctgaaggtgtgacatttaaggccagaacttcaggggtaagaaagactcagccaggtgaaaaaaaaaaaaataactaaagggcaagtgttccaggcagagtaggcaaccatgtacaaagatgctgaggtaagaaagagctcagtgtattctgggtgctgaaaggaggccactgtgactaaggctaatgagtgaaggataagaggtaagagatggaatgggccgggaccagaccctcaggggcccctgtagaccacggtgaagagagtgggatcttattcttagagtcagaagccactgaaggcttttaacaggagaggtaccaggatgtgatgtgtgttttaaaactactctgagccaggcatagtggctcatgcctgtaatcccaacactttgggaggtcaaggcaagaggatttcttgagcccaggagtttgagattagcctgggtaacatagtgagaccctgtctccacaaaaaaaaaataaaaaattaattgggtgaggtggtacatgcctgtagtcctagctaatcaagaggatggggaaggagaatcacttgagcccaggagtttgaggctgcagtgagctatgatcatgccgctgcactccagcacaatgattaatatcatgaactcagacccaatctgtgtgtgtttatatcctccaggctctgccacttatcagccgtgtgacattgggcaaatgccttcacctctctaagcctcgatt

SEQ ID NO: 137836 - DNA, 1603 bp, Homo sapiens
ccaatgttctaatgcttgcatggcagagcacatctattcagcacaaaaatgtgctgattattagccagtataatatggccgttgggtgactgtgacaggacctgacgagatgggtcagagcatccatcaacggtcccttcctcatctcactctctttgatctctgccaccaggcctatgttttgtggcaaaaaggaatgctgacatcaaaagaaggaagtctgtttttgtcagcattttccttttctctttcctgggtttttagggctagatctgccaatagttttaaaaatacaaatcacattcagcagtcattttatagaattgttgcaaaattcatcacagaaatctttccattgggtagatcacctcaagagatctggattccagagatctgagtcttgctgatggctcttgatggaactgaggagtttggattcctcaggtacatatttttggggagatgggagcctatttaatctttgcagaccttggactgcccagttttacactgtgcatgatttgactggtccaccaaagtctgcctactaggtggtttaaaaatatcacaaaggggggattaggggaaattctgcaatttgaggttgtcttttcttaaaacatttttctctctttccttaccccccttccctctcctgctgttttatgactattctttcctaacttcacaattcttgatggagacaggaggctataaccttgccaacacggctcgatgctggacatacttgaccggggtcatcctagggaaaacactatcctctgagatcccagatcatgaggtaagtaaggctctgacaagtcctctcttctttaaggggaagagctgagtcattccacctaatcaaaatcacgtcctcaccactcaataccgttttgttgagagacacttcaataacaataacacactgtcttggcagaatagtggactcttgttccaaaatatccaagaccttctgcctttttgtttttttacaagagatctcaaaggccaaccaactttaatttctcaattaattacagagactgtgggaaggggtcacctgttcacacaaagaattctttggaatatgtgcatatttttatcccctagcctcaaaaaggaaggggctatttttaaaatgtgtaagctggattctcatcttttttttaagaagtttcataggtggtacgtggcacatgttctttggtggtagtcctgatctctcaattttctttgactaatgtaaaattcaagaaacccacaagcactacaaagaccattgctgatgtttttctagcaattagtggcacacagaggctggaataggaccatccaaaatgtgaaacgtcatttgagcccttgccattttctttagtcatacaagatgggctttatgttttccaaagcaaagatgtctgttctagttttcccaaaacaagttcatggaaagctgtctgggacctgtgagtgtgctgataatccctaatccaaaggcatacctttgttcctacctatcaccccagttcccctgcaagtaggaaccatgttatagatcaagatgtataactacggaccttagactagatgacttaaaataaca

SEQ ID NO: 137837 - DNA, 1028 bp, Homo sapiens
cactctaacataggcatgtttaacatacatcctgccctagaaaaataactgttaaaatatgatgagttggagttattctatgtgcagtacttaaaagtaataaaaatgcatttctttttaagtcccacaaaaaccatgcaatgtcaagttaatgatgaaaatcaatccccaaactctttcttgcacacctcattgtatgacggcattgcagagatttccaatcatctgggaaaggatattatattttgatgagctgcaccaggtgctaactatatggcagaatttcggctttgaatcttagggaggccctcaggggtaaagaagagtgagggaagggctaggagcatgtttattgttaacaaatcactattgttcacctaagcttgaaaagtgagcaattgaattggaaaagaagaggtatcagttatataaggaaggtagaaaatgtgattaggaaatgagaaacagagatataggcctttattcccacccgtatgtattaaactgtgctctaggtaaattgtgaattcttcaaggcttagagagtaaaaactaaggcagagagcataagcacaagcagtaaatatacacgtaaatgttctaactatagtttggaatgactccaacactcccctttcccccaagggcatcgctatccagggtctgcaaaggccaaatagctgtttggcttccaatctgattttttgcctaagaaatcagagaagtcggtttcaattttaataatatattctcccaacctctatataacagaaaggcacttgtgtttctgtcccttcttaaagcgaattttgtgtttggtgaaaggtaatagattgacagcactggaaaatgaattactgtattcccagaacaggtataaccgggcagtgacacgatgaaatttctctctgcctttggggaccattagaatactattcaggaagtcactgctctggtgtgctgtgctgaactcaccagtatcctagtgggctgaaagaattaacatagcactcaaagggcctgacttg

SEQ ID NO: 137838 - DNA, 1040 bp, Homo sapiens
agaatttatcttccacctgggactccaggttatcattcaattttagaagcaggtagggctgggcacaggtggctcacagctgtaatcccagcactttgggaggccaaggtgagcagattgattgaggctaggggttcaagaccagcctggccaacataataaaaccccgtctctactaaaagtacaaaaattagctaggtgtgggattataggtgcgcacctataatcccagctacttaggaggctgaggcaggagaatcacttgaacctgggagatagaggttgcagtgagctgaaattgtgccactgtactctagcttgtatgacagagtgagactctgtctcaacaacaaaaaaaaaaggaagcaggtagatcttcagtgaaagagagccgaaaaagtgtaatttactcctttaggcctggtgatgtggcaaaagcaatgcatacacacacatattcataaataactattttaagcgatacaaattttttaaaattctctttcatttgatgagaagggatgaaccctctagaaatttgcatgtgagaacaagtaattatttagccttccatcttcatccctgatatggtctagctttgtgtccccacccaaatctcatcttgaattgtaatccaaattgtaatccccacgttttgggggagggaatcatgggaggtgattagatcataggggcaattccctcatgctgttctcatgatagtgagttctcatgagatctgatagttttataaggggctttccccccttcactctgcccttcctcctgccgccatgtgaagaaggacatctttgcttccccttctgccatgattgtaagtttcctgaggcttccccagccctgcagaacctctataaattacctagtcttttttttttttactttaagttctaggatatatgtgcagaacgtgcaggtttgttacatagttatatatgtgccatggtggtttgctgcacctatcaacccatcatctaggttttaagccccatatgcattaggtatttgtcctaaggctc

SEQ ID NO: 137839 - DNA, 1941 bp, Homo sapiens
atctacagagacagaaagaagatgaggggttgcctgggtctagggatgacagcagggattaactataaatgggcatgagggatcttattggaatggtgaaaatattctaatacgagattatgatgatgaattgcacaactcagtaaattcactaaaaatcattgaattgtatacttaatatgagtgaactttatggtatctaaattatacctaaatcaagctgttaaaaattcatttgatctcacattttaaaattattttacattagttccttataactatgaatcatgtaaaaaatgtataatgagatctcatgttcatggatcagaaaacttaatattgttaagatggcaatactcccgaattgacctaaagattcaacacaatctctatcaaaattccagctggcttgttgtagaaattgacaggctgatcctaaaattcatatggaaatgcaagagaccccaaaacaactaaaataatcttgaaaaagaacaaatttgaaggactcacactgtaatcaagaccatgtggtcctggcatatggatagacacgcagaccagtggaatagaattgggagtccagaaataaaccctcacatttatgatcaactgactttcaacaaaagtactaagacaattcataagggaagaacagtcttttccacaaatggtactaggatctacatgcaaaagaatgaatttcaatccctacctcaagccatacataaaaatgaattccaaatggatcataggccaaaatgtaagagctaaaactgtgaaagtcttacaagaaagcataggagtaagtcttcatgaccttgggtgaggcaaagctttctcagatatgtcacagaaagtacaaaaaaaaagaaaatatagataaattgaccatcaaaactaaaagcttttgggcttcaaagaaagtgagaaaaacatcaagaaagtgaaaatacaaccaatagaatgggaaaaagcatttgcaaattatatttctgatcagagatgtgtccagaatatataaataattcttacaactcaatgatgaaaagacaaataacctaattcaaatataggcagaagatttgaatagatgtttatccaaaaaaaaatataaatggccaataagcacttgaaaagatgctcaacatcattagtcattagaaaaatgcaaattaaaaccacaatgagatgccacttcactaagatggctagaatcaaaaggtcagataataacaaatgtacatgaaggcatggagaaattagaatcctcatacattgctggtgggactgtagaatggtgtagccactttggaaagcagtttggcagttcctcaaaagcaaaccatataactgcaaatgcacgccattatccattagaagcttctgaggaacaacaagaaagccagtgtgcctggagcaaagtgagtaatttggacagtggcacaagaggacagagaagttgccataggccacatcatacaaggccttatggaccatggggctttggattttattctaaatgcgacggaattttaagcaaggagtctttgttcttagtaagtttataatgtccactgtaatgaatgagaaaaagacaattagaagaagtgctgaacatccttgaaggcccacctgtgatgggaaccataagtgtttaatgtgtgtctgcagttatagttttgtgggtttttttccaaaagcacttggctgtcctagctttgaaagcagagaaaatggcagaaaggggtcagatgctaagaggaaactaaacatgctaaactcgtaagtactcaggcaggttcttacagagaaagatggaattttcagaagcccttaagaaagggaatgctgtatttctactttttgccatcttttactgctttgctgtaaacaattagatgcaattaacttagtgaaaaaaaaaaacaagaatcagaa

SEQ ID NO: 137840 - DNA, 1051 bp, Homo sapiens
tggaaatttagaagagggctgaatccttaaggaccttgtgtaacatactaaagtgtttggactttatcctaaaggcagtgggaagctagaaaagatcattaagcagggaagtgacacaatcagatttttctttgacaaaaataaccctggcagcagtgtggaggatgaaatccagggggtgagactagaggcaggaagactggtacagtcagccaggggcgcgataatgaagccaatggcagaggaaataagaaggaggggccaaagggaggttttatgaagtagaattatccaagagaggaagacagaataaacaaaattgactctaaggttgccagtctgagaaatgatgttaagaatacaggaggaagagtgggtttcagggcgtgataatgatgtcatcattggtcatggtgtcttcgaggtacctgagaggtagaaagatgcctggtaagcatttgatcataagagtggagtgcagcagagtggtctgggcataaatgagaatggcatgtgcaagtaacaatccttaattcaacaaatatttattgagggcctagtatgtgctatacactggaggaagttctcaaggtcctggagttacaaaggtgaattagacagtttccacccactgagagcacaccctaaaaggaaaaccaagatacagaaacaaaccacgataaggcagtgtagaaatgcggcgagagaggtgtgcacagtatattattaagggagcatggacaagacacatctaacctaggggagaagaaggatggcttcccaggtgatgtgctgtcttagctgaatcttaaagaagaaataggagttaatcaagtaaaaaaaaaagagagggtagagcattccaggcaaaagggacagcaaaagcaaagttggggcaggagcagggagaaaaaacagtgtaggcatttcagtattgctagagcacaaaatacaagaaatgaaactaaagtacctaagggctgggtcacaggaagccttaaataccatgttcaggtagtttggactataaataatagggagctagtgaaga

SEQ ID NO: 137841 - DNA, 1512 bp, Homo sapiens
ccggatttacctgagttccttaaattaagttctccagtgaattcaagatttgatttacaaagaattatcacatgacttttcaggaatatattcctgaatcaaattttaccatagtattactatttataaaatgtaggtattttatgatagtattactatttatacaatataggtatttcacaatacacagtctatgcactaacataaagcaaagagcagatttcacagaactttgttttcctgtttttttttgtagcaccatatgagatgtgtagatttacatgtaaggtaaagcataaaaaccagattatgagtactgtctagagagaaggagagacacaagggcactaaaagactatgagaattcaatgggcaagagatacaaaaagagaaagaacactgaaaattttagccatttccaatttctgggaaagccatcatgatttctatctctggtatgcctctcacctcagaccaatcagttgaattttcctcccctgctgatctcctgtaaccatttctgcccttaaacatagaaattacttataatggtacaaatagcatcatttaatgaagcgacagtagaagcaccaataccacattcccagaacagcttaagaggtttgatcagctagtactgaaaataaggaaaacaacgtaccttgtttgaaagtaagaatgaaacttgctaagcccaaccctggatcataaaagctacaggcttgggtaggggtgctcttaaatgccaaagttacagctagaaaaatgacccttgtcctgacctgccaacaaccatggaaatttacagaagctccaacaactgcagctctgtagaaatggtggacagaattataaaaagatatttcagagcttctagctaattgcagttaaacacccaaaatgtatgaagtgaataaatttctaaagggcatcttcccacatcagaaaaagcatcagctgttttctccatctttccatgtaataatcagcatatatcaagtactggaactaccatccataattctactatgacgggccccttgaaaaggtacatttcaagaatcataacttctttccatttatttagatcatctttaatttctctcaacaatataattttcagtatacaagtcttgcacttcttttgctaaatttattgctaggggccggatgcaatggcttatgcctgtaatcccagcactttgggaggcccaagcagtaggatcacttgcggtcaggaattcaagaccagcctggccaacatggcaaaaccccatctctactaattgtacaaaaattagccgggcatggtgatgcgcgcctatagtcccagctattcgggaggctgaggcacaagaatcgcttgaacccaggagttggaggttgcagtgagccaaggtcacactactgtactccagcctaggcaacagaatgagactttctcaaaaaaaaaaaaatatatatatatatacacatatatatatagctacgtattttattcttttgatgcta

SEQ ID NO: 137842 - DNA, 1106 bp, Homo sapiens
ataatttgaataaaagaatgaaataatgaatatttagaatcaacagacttttcatcttgaaatttgttttgctaattaacagtggttagtatttccattaagaaaccattcttcagagttcataacctggctgataaagataacactcatgatccttagtcttaaagaatctttaggcaagaggaggaaaagagtcagacttggagtttgtgtgccttatttgtataaatgatagtgtcagacaagagtgtatgttgtaaagccagagctaggagtcactaaagccccagtcaggcctctgctcccatatcagctctttccttctcaggaggggtgggcagctgctgaaggatgcggttcctctgggcttgtttgaccccacgggaatcattagctctgcttttgtacatggggatttcactgcttgagaaacctgctgtccacaatgtgcttgagagctgtagggttgttcaggagaaagaaagttaaacagactttgcttattgtcttaatcatccattgttctcactgaaattctctgaagggattttgggtgtctggatttgcagctttctgacctgggttattgttgggggtgcggagctcttgtctagttatcatctgatggctgaagcctccaactgccctggatccaggcccatgagctgggccctcatattaggaatttttcattaatggaatcatttcaaatggtctgacaaaataaccctttttaaaattttgattaacattttttaagaatggttttagatttatagaaaaattgagcagataggccaggcacggtggctcatgcctgtaatcccagtactttgggaggccgaggcgggtggatcacgaggtcaagagatcgagaccatcctggccaacatggtgaaaccctgtctctactaaaaatacaaaaaaaaaaaaaaattagctgggcatggtggcgcatgcctgtagtcccagctactcgggagactgaggcaggagaatcacttgaacccgggaggcggaggttgcagtgagcggagatcgtgccactgcactccagcctggtgacagagtgagattccgtctcaaaataaatacataaataaata

SEQ ID NO: 137843 - DNA, 1173 bp, Homo sapiens
cagatgcacgtgtagaacgtaaagatcctggttcatcatggcgcagcccagaagtttctgttccatgtgccccattctaataggatctgcagtcacttgtgcccattagcaccactccaagaagcccacacaggtattcaaatatgcttgtaatctgatggagcgtgtttcataatgtagtctgcagaccacctgcatcttaatcctaaaatgatgattccggaatcagaccctttaggggtggagcccaagaatattcatttttaaccaatgcctacccaggtgattctgatacacagcacattttgataactcttcatctaagtggtctttcagttgtctcctgtctgacctaacctgtagtatgcctttatgatttctacagttgaagtagaaagaccaaggtatccttcaggctctcgggacattgggacattgtcccaatgaactctattgtagattcacatctagaacaccttcaaatcagtgattgatccctcttaccctcttggcccaattcacaccagctactggtgccttgttcatctaaaaggtcttccctttcacaagtcccacggccacctgctctccagccacagccatatgcattaaccacgtactggcggagaatgctactgctactctaacacataacacattggttctcctccccagactcctcagaatgcatttcttaactcactatacccctccatccaggcctcttcccttcaaggcatcaatcgtttctagcccactattgccctggctagttactgaaaccatcaacactccagagtctgccaatacctgggtcaaccaaaaccaagtatggactacacaaggacatagccagttagccttcagcatacaacatagcacaggggttaaaagcaggaactctgaagtcacactgcctgggtttgaatcccagcactatcactttctatgtcaacttgaacaacttaaaccctcttttcctcaagttcctgactataaaagggagatgataatactacctacctcaaaaaacagtgtgatatgatatgaactaatatgtgtaaagcacgtagaatagtgcctggcacatactgagcaccaaaaagtgtttgctcttaaattgtatatgaattacactaactgaatcattcaggtgtgagacatcagtgagat

SEQ ID NO: 137844 - DNA, 1047 bp, Homo sapiens
cttagaggtggcaggagagagtgaggtgaatgtcttttagagaagcatctcttgtgaagccagagcgaaagaagtcaagaatgagtgtggtaaaggagtgtgggggttgcctgctagcacactgatgaagtgcctgtccagtggcctctgcttctctatgttgtcctcttgccttgtgtcacttgttcacagacctctttgaatcctttgattctgccttctgtcatcagtgtcttaggaagtcatcttgttccatgtaaattcccttacatggaactaaccctatccatgacattattcatttcacccagcacggtgactcctaacctccagaatgtgtctagatcacatcttgcttggttactttgactggctagtcttcacccttccaccagccttttctagtgtcttattctgtttggttctgcatctcagttcccaatatcttccttcatcttactgataatccatttaagacccacatctctaacatgaccacatccttcttcccccaacaattctgtaatttaccctcttgtcccataacatttcagccttctgtccagcaacataggatctatgccagttaggtcccctctgtcctgcttccctgctaagagagggagaaattactctcccatggaatgctattggtttctgggacttccacctgggggcagtaaatggtagagccataaagctctatgctgtttgtcttggcaagctctacaggaagaatgtagaactagacctccagctcttagttaccacccacccagcagttagaatcaaagctactagagctgtataccaagagcttcaccctttttgcctcagagagagtaaatggtagtgaattacactacagttccagttccccaaagggctctgtgcacagtgtaacttgttaaccaagtagccaaacctcctcctctatccacaccaccccagctccagcctttataaacaaataaataactgcatgaaaatggagatctggattcagtatcagcaacattgcctcaacaccaagggaaacccctcctt

SEQ ID NO: 137845 - DNA, 1048 bp, Homo sapiens
ctaattgaagatgtctattagagagctgataatagggcccagaccaggacttctctacatttgatgtgtatatgaaacctctgggattcttgtttaaatgcggattctaattcagtaggtctgagatggaacctaggaatctgcatttctaacaagctcccaggtaatatatgctgccagtctgtggaacatacttgaaacagcaagagactggagctcaggagaatcaccttcactgaagatagagatttgaaagtcaacagcattatagattgtattaaaactaaggaaatcaataaaatcaccttggaagcatatatagaataataaggcggggggggaacaaacaaatactgagacttatgggactccagtgtttaaaacggggtggaaaaagaaaagcctccaaaggaatcctgaaaaggaatggtcaaaaagaaagagaatcagaaaagacatcatagaaaccaagggtgaacctcaggaagaccagtttgaatagcaatgtctgatactgtagcgcatgcatctgcaacagaagtgatattggccccaagggaacaaaaatttattcttggtagaaggaggtgaaaaaaacttatattttatgatggtttacagtcctccaatgtaccacagtacataaacagatgtacagtatatctgcagtattaaaatgttatgggggggtcaattaggaaaaggtatctaaaaaggctctttcagtagaggtgggacatgataatgaaaaaatgtttgacagcctgggcaacatagtgagactccatctctacaaagaattagaaaattagctgggcatggtggtgcatgcctgtagtcctagctactcaggaggctgaggtgggaggatcacttgagcccaggagtttgaggttgcaccactgcactccagcctgggtgacagagcaagatctggtctcagagagagagagagagagagagaagagaaatggttgagaaacagtgctatagagatgacgtaagatttatcagtaaggaggtgatgatgaagatgtcttcaaaggat

SEQ ID NO: 137846 - DNA, 1702 bp, Homo sapiens
tagtgaatttatttaaaagggggaccaaaattttagagtaatagtggaaggggtagggtttgattaggatgctagcttgaataactaaaagctattaaaatatacatattttgtctcatttaataaaattgagtgctagatataacaatgcactaattcttaaaacaaaaaatatataaaagattcatggcttttgttttgtgcctaatttttcaaacaaaattgcatgatatttcaagatggtgtgtttcacttcctgtgagatatttgtagcatgatctttaagagggctgattttgccaaaatattcaaggacttcattagtgttcccaaaggcttttctttaatcacttggtattcaaatcattctgttttgaaccacttttaaaatcattattcatatttatttttctcctcttcaattgtggactgttctaccagatcctcatcagttttgtgtgtgtgtgtgtgtgtgtgtgtgtgtgtgtgcgctgacttcaagatttccagcatctttttataagatttgtaattttactttctgacagatttgcattgaattgctaactgatatacctgacgatccatgagagacaaaatgactgaacagatggatggggttagattctggtatttaaaggagtgggttctttgagctgggactgctataagtggtcagttcattagcaaacacttgagggcagttggtactgcacaaaaggccattagtgaatttatttaaaagggggaccagaattttagagtaatagtggaaggggtagggttacgacagcttttgtatccttagaaaacctcaaagcctgggtactgctggggctaagataataaattctcagtaataagatctgcctatttcagcaaaggtctagtgcagtgtttttcaaaccagggactgcaacttgttgatggacattatatcaatttagtgggctacaatgagctttctttcatatcaaggtgggtttcgtgaaacttgttctggggtgtgtgtgtgtgtgtgtgcatgtatgtatgtgtttgtgtgtgtgtttgtatgtactaggtcacagtgtgaaatgtcaagccactgtagagtagaatgactgtgaacattaaagtaagacctggatgtaaattcaggctccaccacttactagttatgtgtgtaacctcaggattattccaggaacagcatgtgcagatgcttagaggtgtgaaagttggtggggtgggggggacttccaagtttgtcattaaagctggaaccataggttcctatagataaatggccagagataagtttggagaggtataaagagtccttgaatgccaagctaaacagcttggacttgatcctttaagtcagtggttcttaaccttctttggttgtggaccccactgaattttccacgaccaaaaaaggtttagaaccactgacctaaagaatgcatatacatcccctagaaaatctacatacacaaatttctccttgtagtttcagaaagtataaggatttcctgaagcccatgtatgggtcctagattaagaacttcagctttagacagtgagaagtcactgaaagaatttttagccaggaagaagtaacgttgtcagacatgcattttaggaatatgactctagcaatagttggccgttaaaccagagggacagtgactgtccatagagaaatctgtgaggacat

SEQ ID NO: 137847 - DNA, 1034 bp, Homo sapiens
atgtaaactcttatgcttattgtattgacatttacagagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaactagacagtctctaaattccttttcggctttctagaaattcccctgtcttcgagggacttacagtctagaaacattaacaaaattagaatagagaacaacattagttatggtaccaatggaatatatgtatgagctgaagagacttatcagtagaaagaaattaatcatggaagtcttggcagaagtgaattttagagctagttcttaaaagaagtggcaaacagatttttaaaaaggtggaaaattgacgctaataggtttaaaacaaaaggctgaagaatcaagaagagggctcatgctcctctaatgaaagtagcaacccagaggtagatgtctctcaaagacaaagggcttgtgaaaaggctcttcctaggtgcttcttggagttagaggagaagtcctttggagtgtttgtttgtttatttgtttgtttgtttttgagacagagtctcgccctgtcgttcaggctagagtgcagttgcgcgatctcagcttactgcaacctcctccttcccagttcaagtgattctcctgcctcagcctcctgagtagctggaattacaggcacccgccatcatgcccagctaatttttgtatttttgtagagacagggtttcaccacgttggccaggctggtcttaaactcctgacctcaggtgatctgcctgccttggcctcccaaagtgctgggattacaggggtgagccaccgcgcctggccaccttctagagttttatgttaacatgtcaaactgcagtagtctgtctgagaaggattgctgggc

SEQ ID NO: 137848 - DNA, 1014 bp, Homo sapiens
cacggcactccagcctgggcgacagagcaagactcctctgtctcaaaaaaaaaaaaaaaaaaaaaaagaatgcaaattccttgagagcagagatcacatcataatttacctttgaatcctcagctgtactgtacacttaatatcagataaatgtttgatgaatgaatgactgcagagcttttaactagttactatgggaagacataaattaaagaaacataagatcttacattctagttacagagcacatcaccaaaacacccccaagattttcagaataagtattgaagggatacaaaatggagggtgaacaaagttatatcataacacaaagtcatcctggacgaatcaagtttatataataaagggaatgttcaaaggcttcagtgtcaggctgacctaattttgaattcctacttatctgcttgttaagtatgtgattttgaatgttgtttctctaaactgcatctgtaaaatgggtgtattgcaacctcctttataggactgttgcaaggatgaaatgagataatatggccaatgtgcatgtcacaatcttcaataaatgtttaaagtctaaaaagcaagccagactttaaatatagtaaggatattaggttgtcccagtggtgttagtcagtcagtttaggttgccatgagaattaagatcctgagcactggccagcttgtatcagatcataggggcctccaggaacctccaaatgctgatggtaattctaaaaccgcctcagatagtcttaaactggaccctcacaccaaacctaaaatatttccctaatctatgtttagctgcagaaacaagaggaggtaggaggagaagagctgcagtttccaaacaccactgcttgcaaccttcctaccacatgaatgttcaaggagttacatttgacatcattgcttgatcggaatctaccaagcaatttccactgcaccagccagtctcttgggaaagtactatcagatttgccagagtaaattattgagattgttaactct

SEQ ID NO: 137849 - DNA, 1039 bp, Homo sapiens
cccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctg

SEQ ID NO: 137850 - DNA, 1093 bp, Homo sapiens
aattgatcataatggggaaaattctaaacaattaataatttttaaataatttacatgatttggggacctagtgaaaaatgcctgcatacaaactcatattcacccttttgtccataaacctatttcttcctggataaacagtctagggcccaactaattggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctc

SEQ ID NO: 137851 - DNA, 1031 bp, Homo sapiens
aataaggatatatatgaaagttttttttaaatgtgatggggaagaaattgaaccttattatcctctctctttctctgtaatctctcatactacatagttcgtcccactgattcaaatgtcagtcctgctatttctatccacgagattggtgctgttggagcaaccaaaacagaacgaactgggatcatgcagttaaaaagtgagataaagcaggtaagatactacctgggagattagctgggatattgccatgtttcagaacattcttttggaatcagactttgttgggtcatttattttgtttcacattctgagtttaatttgagccatttatgtttcaggtggaatttcgtagactgtcaatctcagctgagagtcaggtgaaacaactagggatcatttaacatggtttaacttacctttagttctgtataacatgcatgagctcatggcctttttacaaataagataacaagtcatggagtagattgtttgaatcgcctttataacagtcattttgcagatagctttcctttttctggaccaaagtactttgttaattttagaaggaaagtaacttgcatctgataataagaaattgaagtttctcttattaggactgatgtaattttggaattaattttctttataaaacaagacttagacttcaagcaaagagtctttgcttggccagagtttaggtgggcttctcaaccttttcctaggcccatttgtgcacttccttgtaaaatccagctttagcaagagaaccctgctaagtcagtttagccagaaactcctatcctcgatatcttatcatccttgacatctgatcaggctcctcatcttctaccacccccaggtgatgtccaatcaccctggcctgtcttcagcaaaaatcctgttaagatggtttagccagaatcctccctacctctgatgtttccctcttagtaattttccaccacttggctataaattcccacttgattatgttgtattcagaggggagcccaatctctctcccttac

SEQ ID NO: 137852 - DNA, 1045 bp, Homo sapiens
taggcattgtgagacctaggccattatttttgtctatatctactctgtgtgcaggaaataatggtatatctagccatgtatatgcgaacccagcctggcctctttgctgaaatgtttcgacttcgaattggtctgatcatacaagttatggcaacagaactggcccactcccttcgatgctcaggtacttaattcagtaactattttaggtggaattcacttttgatgtaagtttatagagtttggaataaggaaagaaagaaagctaaaacatttttatccatagctcagaagctggatatggcaaccttgttcccctgttggtcactatttatgcaagtcaaggagctgatatgatgacacatttgtgtatcagttcgcagcttcagaatgccatctcctgtgggctcttcactccaaatccctcttgacttatcactcgttgctaacttcatttctctaactctggagagtatttgagtgtgacagacagagttgggttaagatttaggcagtggagcgtctgtacaccaagaatgagtcactacatcagtggatcatggtgtcagtattctgtctagtcaccatcatgactgaataaaggaagatgacattttcattaacatctatctgacaagactctctttgaaattaactataggtgtatttggcaagataaaagttttagttagaagaatagttggagcctgtgaaagctgtagggcaaaatggtataaagtgtgaaggggaacaatggacccctatgacatgactccttattccattagtatttgtttgatttcaacaagaattgcaaaataatacagatagggatggcatagaaaaataaaatcaaagttgtaaaactcaattttagccattctttctgttaaatttcccccaaaagacttttaatcaagctgttaacaagtagctaaatttatcaatttgagtcaaacctaactcaaacacatgagataatttatatttaagtaaccctttgacagaagagagctaacaattgttttatacctaccatatgcca

SEQ ID NO: 137853 - DNA, 1003 bp, Homo sapiens
catgttggagttctttatatataagggaaattatcctatgaattgcaaacattttttcctagttggtaatttgtcatatgactttccttacagtgatttttgaaataattcatttgttaaatctttgtctttaatttcaactatattgaagcccatgaatagggtaaaagaatgcattttgtcaaaagcacagctaaaactaagacttattcttgtgtaggtactggctttcagagctgactgttaatcatagttttataaggattcttagtaaattacattgatttcctagtgagagagacctatcaaaaacaggcatgttcattataacactgaaagaaaagatgattgccagaagctttacttaaaactgatgtagtcctgtcgttaaaattctagaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggtactataaattcttgaatttataccaaatctaaataagcgtgctttttaaaaattggtttctataattgttttttaaaacaaccatagcctctaaccatttgagatgtcttttccacataaaatttgatattcagttcttttagtttgtgaatgacaagtaagaattgtagatttataaaatgttataaaccataacatctttataatgatattaagaattctatatcttaagaatgaatttacactaggttcctacctcctagaaagggaaacatccatacaccattagtgggaatggaacttagtatagctacttatgtaaaacactatggaggttcatcaaaaaactaaaagtagaactaccatgggatccagcagtccaactgctgggtatatatcaaaaagaaaggaaatcagtatatgggagagatatctacaactccca

SEQ ID NO: 137854 - DNA, 1050 bp, Homo sapiens
aaaaaattaaattcccaagaaaaatgtgttctagtcaaaaaaataaaaaagtagtagtcctgtcagtactgacatgaaagcatatttaatacgtgttttgggtaaaacagtttcagaacaatataaacagtgttatcctatgatataaaagaaaaatgtgtgtgtgaataaactattttctcatcgtaagaggtattgattttataactcccttttggaagacgaaaagaaattcaactacatttaacatagatctcaattataggttggattccaatttcagaatgctaaactgtaaaaagaagacaatttaaattcaaggaaatacagtggatgtgtgtgtgtgtctatatgtatatacatacattgtgtatgtgtgtgtatatatatatatgtaaaaatgtttgctgatttgatttgtgctctagaaatatttttaccatttctcaattctgtatcaggatgcaacaatagaatgaaactcagtggacgaccctacagacacatgggagtgcttggaacttcaaaactctatgacattcggaaaactatctttactttcactccacaggtgggtgaaataaactggaatgtgcattgagatgaatggaaataaaagaaaatcattggagaaataaagcatttactggagttgggataagtgtcaaagagttccaccaggccttgcacataacttactcagttaatatttatagagttgaactgaattgaacttccagcacagagtttcactaagtgattgtaactgccaaaagtaaccctgggtattgcagaaactaaggattttacaaatgctagagtacttataaaagtaatccttacttttaaaagttaaaaataaaactgtatgtgtcctttataaacaaaatacaaccttttttattcagctactaaattatgttttctttgtttggaggaagggccctttttacattcatagaaatcttcagtatcctcttctaaacaaaaatgtcggtactgttttagctgttattaaacacgttgttagcctgatgtttattagctaca

SEQ ID NO: 137855 - DNA, 1110 bp, Homo sapiens
agattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcgcgccactgcactccagcctgggcgacagagcgagactccgtctcaaaaaaaaaaaaaatttttggtttcactcctgaccattgagtgcccaactattatcattgacttcttcagtttctc

SEQ ID NO: 137856 - DNA, 1331 bp, Homo sapiens
attttcagttttgtttaggattactctccatattgaaagattaaggtttttctcattggcatgaggaattttctcctttccttcaaaccctgattagataccatagggtcctattgaatataaactcatctccaattttaaaaacacaaaatttcccagaggaaaaaagtgggtcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggatttttgcatctat

SEQ ID NO: 137857 - DNA, 1051 bp, Homo sapiens
tcaatttattaattttggatgctttacctgagaaagggaaatgtaagaaacaacttaatttccttttatttttcctaaattgggggagggcaatgtatccgattatacctagtttataaaagtaatgggacctttgccagagcttcctaaactaatgtacttctcaaaataccatatttttgacattttaatttcttcatcttccaacccggttattgagatccttggtactaagggcatccagggtgggaattccctcaaaatactcttcttctccttttttaatagaaataaatatttgatgataaacctttcctttatttcctctaaaacacacagctcagaagctgaatagccttttcttaaaagtatgaactggctacccagatatgtcctcctgttgtaggggaggtttcttcctgaataaatgtatttttaggtttaatttatttaaatagaatgacaactataactctatttctaataatactttaataccaattctggagttatgtctacaaagcaacaatgtctgaatatctcttgtagtttttcattttgagtccagaatgcaagcagaaatgtatcaaagaggcttataggagacatagccattcattcaacaaatgtttattgattcctgacttaacatttgattttcagctcaatcagcagagtttgataggtacttggaataaggtagatattatttgatcaggcctttgaggaataagtagaaatttacaaatcagagaagggaagggaatagcatgaatataacatggaaatttgaaaggtactgcccatcaaggtaaggctggatatcttctatggttagagtataacatgcatctggaaaaatgacaaactgtgaaactagaaggttgggactagctattcgagggcctgtgtaccatgccatatagtttgcagtttaggccatcatcagtagcgagtcattcaaggtaaataatcaaggaagtttcagatgattcacttcagtagcaggaagatagattggataggaaagaaggttaagatggcagactag

SEQ ID NO: 137858 - DNA, 1037 bp, Homo sapiens
tctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatatagatacagtctcatacccatagaaatataggcacacaaatagggatatctctttgcattcatggtaccatcaaatttcagcttcatctctgggcctcactccagttctttgtgctaagttttgttctttttgtgtggtcattcattttttctcatgactttaactattacctttatgagaatgacttctgagtcttcatctctgacctcacttcaattttaaacctaggttttcatttgtcacctcatcagtttcatctgcatatactgtggctcctcaaactcaatgtgtctgaaaccccacctttccaactaaaaacaaactacaaaacaatggaaactcatcaacaatctctttttctgttattactgtctccattctaccaaccacccaggcaatattacttggagtatttcccatagtatgttctgtggaatactaggccaactaagtttgggactatgttaaagagcatgtgtctttactccataatttctcagagcctttgatgtactaatgtgcatattttgtctaagatgggagtgaattttatagcctttccagaatctcttagactagcactctataaaacagtgcttgaagtgtgctacttaaccttagaatgatttttgacttctccctcttaccttttgatgcatgcacacc

SEQ ID NO: 137859 - DNA, 2076 bp, Homo sapiens
agaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggaggaggaggaggaggaggaggacgacattgaggctactggagaagagaataaagaagaggaggatcctaagggaattcctgatttttggctaactgttttaaaaaacgttgatacactcactcctttgattaagaaatatgatgagcctattctgaagctcctgacagatattaaagttaagctttcagatcctggcgagcccctcagtttcacactagaatttcacttcaaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctcaaatggaagggatggaaatgatgattttttacttggtcacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcttgtattttatgtaactgtgataaataatgaaacttagttatattgaggttattgtttgtcggtgaagtgttagtcacagtattttcaaaagtttgcacatattgttctgtgtaattgtgtaagccataattacagtgtttaattctcttttcctattacatcattcattgaaagtgatcactttaccatttt

SEQ ID NO: 137860 - DNA, 1042 bp, Homo sapiens
gaggaagatctaccaagcaaatggaaagcaaaaaaaagcaggggtggcaatcctagtctctgataaaacagactttaaaccaacaaagatcaaaagagacaaagaaggccattacacaatggtaaagggatcaattcaacaagaagagctaactaggttcctggcccacgccatcgggtctgagctgcgccaactgctctgagggttcgtggcccaccgctccttcatggttcctgctgccactgtccacgcttagcgctgtagagaagatggtgggtcggaacagtgccatcgccgccggtgcatgcgggaccctttttattgcgtactgcatctactttgaccacaaaagatgaagtgaccccaacttcaagaacaggcttcgagaatgaagaaagaaacagaagcttgccaaggagagagctgggctttccaagttacctgaccttaaagatgctgaagctgttcagaagttcttctttgaagaaatacagcttggtgaagagttactagctcaaggtgaatatgagaagggtgtagaccatctgacaaatgcaattgctgtgtgtggacagccacagcagttactgcaggtcttacagcaaactcttccaccaccagtgttccagatgcttctgactaagatcccaacaattagtcagagaattgtaagtactcacagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtccattttatttatttttcccagtgaaaagtgtaatttgatagagaacttttcattctataaatacactatgggttactaaaaaatcatggattttgtttattcctgaatcatagttaaacagtacatatgacatggctcatgttaaaaatacccagtgctcggttttgaaagataggcaaaa

SEQ ID NO: 137861 - DNA, 1263 bp, Homo sapiens
tttacattccacatatgagtaagatccttgagtacttgtatttctgtgcctggcttatttcacctatataatgtcctgtaggttcatctatgttgttgcaaataacagaaattcctttttttatggctgaccagtatttcactgtgtatatataccatagtttttaatccattcatccaccgatgaacacttagtttgattccctatcttggctatcatgaataatgtggcagcaaagatgagaatgaagatatctctttgacatactggttttatttcctttgaaaatatacctagtagtgggattgctggatcacttggtacttctatttttattttttttgaggaattaccatactgtttcccataatgtctgtacataatgactatgcattattcccaccaacagcgtactagggttctcttttccctaagttttcaccaacatttgttattttgtctttttgatactagctattctaatgggagtgaagtgatagctcattatggttttgatttgcatttccctgatgattagtgatgttgagcattttttcacatacctgttagtcatttgtatgtcttcctttgagaaatgtctattcaggtcctttttctattttaaaattgggttatttgttttctttctgagttgttgagttctttgtgtaatatagatataaactccttatcagatgtatactcggtaaatattttgtgtcattctgcaggctgtttcttcattctgtttattgtttcctttgctatacaagtctttgattttttaaaaaaattgtaaaacaatcttcttaaactcctgaatctaccaccatcggtttagtgagttctttcttatttatttctcaagttatttattgtctctctttggaagtataacttaatctttacaattataactgtacttttggacactaaatgaaacttagaaaagtgactattcaccaccaagcagaacttttctctcttttttacaaatcaaagataagacaacagtttggatgattaaaatgtatttttaaaacttcacatatctaaaaaagtatcattgccagacaggctacagttcgatactagtgttctgatttacattcttgatcttttaatttaaaatttttttctatagaatttctttatgttattggtcatcatatcatttttattatgatgatggaatagcttaaaatacaggactcagctacattacaagtgtgactgttaggtagatgatggcttcatcgttgt

SEQ ID NO: 137862 - DNA, 2168 bp, Homo sapiens
gggggagtgcatgtgtgatgctactggcaactagtgggttgaggcctgggttctactaaacaccatacaatacacaggacagacctccacgataaaaaagttaccccgtgcaaaatgtcaacagtggtcagaaaccctggtttagagagatgtagtgtgatggcaaggaaaagaggacaatgagtttctgaagagagtgtctatcgtggggtgaggagatgggagttgtagaaaggagatggtgcatatgcaaatgataaaccactaacattcatctaacccaggatttcagagctgaaaggtattaagctcatgttttctagcaccctagtaaaagggaacaaatgccaaatagtggaactatcttacccaactaaattaatagcaggagcaagaccagaatctacatcttactgattctcagactgtcctgccttctcctcatattgtctttcttttccatagcatacatctaaccttgctgtgagacctatctggaggtagggaattggccaaataaactctgaaacatcatgtggattttaagattcacggatctcatgaagggatagaaagggaatgaaagtatccaaacttggatagacattctgttgttgctgaaggcattggctcagtcctatatttaacagtaatgcaatagcccaaacccacgtgatgaaatccaagcttccatcatttttgtagaaatacttacatgtaaaattacagaagttctcgtgttgatgtttcacatcattgcacattcctgcttctcctggaatgggaactttctttcctggtggccaagaaaagcctctataccatatggattttctgtggaatctgctttctgaagtagtgtaccactctagactgatgaactaaatgtggcaggctgagtagaaataaaatttctcttttaacttgtttcccttcttccagagagaaactgtcctaactggcacatgtgcatatatttaaggaaatgagctggatttccacctgctgctgaatttatgagctgtggatattgtccagacacgtttatacttcttcaagggataggatttaaattcaattatttcaggtgtgaatgttctcttcttagggatttactcaggtttacaaagagaggttcagtttgaaggtaggaaaacattcccttaacatttagctataccttccataaactcaattgaacttcttttcacgtgcttatcattcatcgatcagaaaaccagaacaagctggggtttgtgtagaaagctattagtagactgaaacagatccaaaggagatcttcaagtaaaaccgtttatatgatcttgaaagtttcctcagtgtctcaatgaggcactcaatcacttttacaaaattccctttctggcctcacctgctcacgcatcttatgcatgagtccctgaccctagttccctaaacatttttttactcattttaaactcccattagttacatgctgctatttctatctggaatgtattcttttcactttgtttgtcaaaatctaacctattcagtaaacaccctggcacccaatagctacttaataagtaattatggagtgaaagagttctaatatagtctcaaggatcaaaatgtctccttcagtttcttattcttcagtacaacccatttagtcattatgattgtttatatctatggttttactttatgaagtcatttctttattgccaaaataatataaatattgccaaacattgagaaaatttgaaagggttctactatagtaaatcggataaatgaggatacattcaaacttttttaactggaaaaggttgagctgcttcaagctaaaagaagcataacttttctgcattgatatctccagtaaacgcttacaaacatcatttgaatttttattttagagaatgtcattgcctttccttgcttattggatgcaatataaatgttcccttggaattcactaggtgggtaataaaagtgactcactccactttggctattggatttttcatgcattatttcttccttgaagctaggataatcttcattatccttagtacatagatcctcctgctctttgatgactcagctgaggtatacagcataaggttttgatttatgtgtacattttgagatgattaccacaatcaggctaattaaca

SEQ ID NO: 137863 - DNA, 1434 bp, Homo sapiens
cattgggccctcctactactgggagggagatgaggaatgcagagtttaagttcttttttgtttatatggtaactgaagctgagagtagggcagggtcttacccaaggcagacactattaggtgatctgtggaactgtgacctaaacccaagcgtggctgactgtagacctctgcaaggcactccacctctctcagcctcagtttccaacacacaacaaatggggcagacaatagagaccattctatagggacgttgggagaattaagtgcactagtagtgtgctcagtaaatagccattattattgtcatctggagagtggctgggacttcacagcgtgtgggcctactgtgcctcttctggttcacatccatgcatggaaaatgcttagcaattggaatgaaggcccagagaaatttaacatgctgcttgttgcctctccattcaagctttacactctgggctctgaacatagcccccattcactcactcactcctatctccctcctcaatccctttggaactttagcaacatcagtgcttgggtttctggaaggagggaagactcaagccctttccgtccaccttcttgatcactgtgatgggcttttgcacttccaggactagatactctggaaaatgagcaacactaggctctgggcctgccctaaagtgtcaccgttgaggcaggacctaggtatgttttggagaaaaattaagattcttttgtgggaacatgagtagtaagggcaagtaccaactggagtggtggaggaccggggctctatacccaccctgtcatcggatctagctgcctggttctggattagggtaaaaagaatgagaaaggcccagggctctgagatgaagaccaaaggacaaagccgtgaagaaacaggcttctttggcatccaaggatggctcaactctgggaaagaggtgtatatgaggaggcaggtagggctcaatgactaatgccgagaacccagacttgaaagggatgtgtaggggagggattttgcagaagagagagagaaaagaaagataggccaatgaagaatgggggaaccgtgcaaactcaacactctagccatggtaggagagtctcaaactaacagtctgagaggatgaaggaggccaattctctctctaaaataaaaagataagtacaagtcctggctgtctgcttggagaaagaaaaccagaagtctagttcacagagcaggcactttaggctagagcctgtgctgggtccttgcttgtgcaaactcccatcaggctaactataatcaaagggagtagataggatcagccttattttacagaggtgaagaatacagaactaaacccagtaatgggatcagttgtaatgtcatttttgtcatttcttattgtcttactttgatctccctgttttctttgttaaaatatttaa

SEQ ID NO: 137864 - DNA, 1037 bp, Homo sapiens
aataataatagaatgttcattcacccacgtattcatccatccattcttcctatcgaatccttccttatatatcactcgattagaggttcaggatgagaggcagctatggaaagtagaaaaagaaatggattgagtcagggctcttagacgctggtcccggttttgcttcttactggccctgtgaccttggtcaggttgctttttctcatttctgcgccttgatttcttcatctctaaaatgaagggtttggagtagatggtttctaaagcttttcagttctgagataatttacctccaagggattttgtatgcccaagtatgaaatatacaggcattaaatatatatggaaattaatactttgggagctgagcataatttctttaaaatttatccagggtggttttttaaaaaattgaaatcttgaggaaaaattgaatatttcagaaaataaaatggggagggacttcataacagctacaaggcaaaaatgttgatgattctccgggatttaaagagtgcttcctcatttttatttgcttggaccataactatttggaagtttgagtactgtgtcatgttcatcctctgaactatgctatcttttactgcattttcaaaataggttgccttttgttgttatgtcatgctgcctctggttttgataatggctcacctagtccctttgactttcaattgagttcatgttacattaaatcatatatatgctacctcccttatattagcttcaatttttaacatgttgagtttttttttttttttttttttttgagacagagtctcactcttttgcccaggctggagtgcagtggcgcaatcttggctcactgcagcctctgcctcccaggttcaagcaattctcctgcctcagcctcctgagtagctgggactacaggcgtgatatgttgagtattttaattgtaatatactttcgtaatctttgcatcaaatatattaacaaatattttgaaattggggaagtgttgggggagggttttagagctgctttttgattag

SEQ ID NO: 137865 - DNA, 1035 bp, Homo sapiens
gccttaaactatataccctatctgaatgaaatatttaatattctctaccagccctgatttttttccattctttgtgcagccttctgttgtatagagcattttgtttcttctcaaagtttaaaatttgagagccctcacctcaaactcagtatattttaagctcaacatcctctccacattgcccgtgcttttcatttgtttcatttctttccttgatgccaccattctgatctcccagggtaacattcaaaacctttgagtcattttgactcttccttctccttgaattgccctgtgtcagtctgccccagaattatatcatcatagtttctgaaatatctcttagatttttcattttctcattcctatttggcaccactctagtttgggttgccatcatctcctgcttgacttattgccacagtctgctgcctctccctactccagtccatcctgtgtgcttgtgccaaactaattttcttaaaacacagtttaatcatgtcactttcctgctgaaaacctgcattggatattaattagctctgagtttctgtgccatcttccttcaatctcagagttcaaggagaccctccatttgtccaatgctcacctgtccatttgtgccttccatacctttctcttccagcctcctcccagatcttgctcaaccaggcctcccatctctccagtattacctctctcagcctgtacccatattcagtctctaatttttaaaaaacaaaataagacaaaagccttcctatgcccatgttccctttagctactatccaatctctctttcttatccttcaaatttctaaaaaagtagctacatttaccttatctgttttctctttacccctctctgatctggattctgctaccaaaaccacagaggagctatccttaattaatatcactgtgaccctcttgttgctaaattactggacatctttcattccctatccttcaggttctctctgctgcatttgacacttatgatgatttcttctttttcagaagcttctactccag

SEQ ID NO: 137866 - DNA, 1058 bp, Homo sapiens
agagagttttcaagtctgggatctgttttctcaaaattggtcgagcacagacgtgaaagccattcataaggattaaactttgagtatctgaatagcaactggtcacaagtagtcaaactctgtagttccaaaggctgtattagttgtggaggggtagtttttattaggaacatttgcatacatacacaaaagtggaaagaatagtataatgaaatcccacatagtacccataatccagctccaacagttatcaactaaagtaggttttaacggaaacatctcagttaaaaatggacacttccagctcaatatgtgtttctctaacttattattttttaatcctacatcatgagttgagttagaatcccactttaatgtttgctttttgttaagctttttaaaaaatatgttagtttggattaataatcaaagatttattttctataaatgtcatataaaaatttttcagggcacatttttaaattaaaaggccaaaagaaaaatgcatgggtttataacttttttttaaaaaaaagggaagatttaagtatgctgggtagaacatattttgttctgtgtttgttttgaaggtttggcttgagcaacaagtttgatactgaatttccctccgttctaacagggaaggtaagtgagaatttgctttgaacttttcagttctaaagcattgttttatggcttactcattgttatgacaaatgctttgaatcattgttaatgaagtcaagtaataggaggcctcagtagttggaagctgtgtttatagtgtttgaaagctgttgccatggctaccagcctctgaccagttattttgttcattgtccattaatgccagccattatttatttgtccgttcagctttttcacttttgcattttttttctcagcataggtagctataattgtttttatttgggtcattaatttccagtgcttttagagttaaagttatttttttaactgtatcactctattaatttttaaagtaccatatggtatgatttgttatacatgaaaataattaaatttttgattagatg

SEQ ID NO: 137867 - DNA, 1348 bp, Homo sapiens
ctggctttcaatttttcattgcttttgcaaattttcttcatctaattctaagagaatacattattattctctggcctcaccactaatttgttctgttgactgttgaccttttctgtctctcctgaggtataatatcaaatcatttcacagaatactaaacaggtgatcatagttcctggctaagttagccttagagaatatgtggccatttaacattttaggacacaaagaaccctttggtgtgagattttggctcactctttagtacgttctaccttcctatcctgatcaattggagtaatttaccaattgaagcggcagcctatacttagatttgttttatatgaattaatcataaatgttttttcaaatgaataaagtagctatggaaatatatcttgaataatagtgtatttttgtagaaagatggcaaattcattattaaaattaaagagaatgtgaattataagaacttcagtaaaaaacttattcttcatgtttcctttgatgctgctgcatgtgttgtaggtgtagttatatccaactttaccattggctttgaaatacaggtccaagaaattctagaaatgaataatcaaaaaaatatgtcagtgtataaaattcccaggcatacaaattatccattttcaaaattggccaattttatatgctcaaggaatcttcagaatatcttttcacaccttctcatttctttacaagccttctgaaactaaaaattccagtggccccaaaggtagtagactgttttaaactagaggagtaagaataataagctgcttttggtatgcactcacacaacctaaattatctggatatgagctgctcataaatatatccattcttttcaagtgattgtttttgtagcacattgtcataatgacttgagtatttaagtgtacattatgtatagtgtacaaaatctatcatgtgttggataaggcataaattataactgtgatatttttcttagcatgtgtttggtgatgggaaaaacactaaaaggaattctgaagatctgatttaaaagtcacatggtggtaacattagctttattcattttctcattaatgagataatttttctccgacaggcactttcatttgtttaggttcctttgcattatcaaaatgcttctcagataactggagagaaaaggcaaacataattaatgtatatctgaggaaaaaaataaaagaaaaaaggtctaaattccagacttaacagctcttacattaaaatattttaaaatgaataactgtgatagctaaagtagaaaaaaaatctaccttttatgaaatcagtcttccaatatgaatgtgattctaaa

SEQ ID NO: 137868 - DNA, 1017 bp, Homo sapiens
agatcagtcctgctgcggtttgcttagagtttcttctgtttacagagtctcttgcatcctgttataaaatattatgaccctttaccccacctttatggtgtggttttcttttttcattccaagaaagccaaaagaaatgaaatgtttctttacaacctactgttcagctagaaagtaagggtcttctgctgtctaaccttcattgctagagacactcaattatatgaaagtaaatgagtaaaatgttaactctgattctacacagttaactaaacatttctttcacgttgtttaaaattgagtttactaattctcacttcttatgtctttagctctgttttatgacttttactgttgctcagatacagatttctttcaaagacaatcctggtctccttttaaagtcaaaatgcagattttagtttattgtttgaaactctagtaaaagcttttcttttcaatatatttgtcttatgacctcaaaaaaaatttgaattctcatttttagtaacttgaatattttagtttttaattcgtctatggtaagaaaatagaaattgagaccattatatgttaaaaagaagaaagtgttggcaggaaagaaggaaaatgaccacatttttaggtaatgtttttgttttcaattccagaagcatataataaaaggcaaattttataacaaattttatatacctcaacatacaatttattttattcacagtgtttgaaataaaaagctattttctcttccctcttttattctctagcttttgtctccctcagtcttctaacactatttcatccctggtagaagtggagctttcttttctaaggctccttataaacaattttttttttcttttggactgactcatttctgcaccttttggttttattttttttccatctgtgtttgtacttactttttaaataaaaatgtaaattccaattataagcatttaaatttgtaaatggacagatttaataattttatgatttgcatgagtttatatcaaa

SEQ ID NO: 137869 - DNA, 1025 bp, Homo sapiens
ggtataaatctaattattccagtcatgtgcatgcctttgaactgactttgtccttgtttacagagaagcacaagcagccacttccaagaatggaggtagtaactagaaatattaaacttgtgtatttaaagacctttcaactttaaaagtttaccgcagttatgaatccattttatactgaatattaacaggctgttttgaatgcaatcactaggcattgtcttttgttagtgtaactaacagtggctaatgttaaaattgttatattgcaaatttgccagggaataagggtttgagagttgccttttttcaaagtaatccaggagtattgccaaggtctaattttaattgcattttctctagtagtatttgggttttttattgttgtgttatgcttctagtcttacccagcttttactcagaatgactagagactatcaattatactgccttgataatgagaatatttggtaagaaaaaggcttgaaagttatccttttccgtcaattttattgcagtcattttattggtggtcatttcagaagattgattttcaacatcaggctaagttctatgaacttgaaattatattgttgtgcttttcaacgtcatcctagagtgcgtgaacatatttatggggaatatatctatttagatatttgtgattccttaaattatttgtaataaatgtttttcttagatttagagataaacagtgaaaagctgcccacaaactgttaaagattgtaccctcttgtaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagagtgagtaactgttttattgtataataataataataactaacatttatggaaaacttactatgtgctatgaactcttttcaagtactttacacaatttagttaattcttg

SEQ ID NO: 137870 - DNA, 1065 bp, Homo sapiens
tataggtcagagtgccttgagttccccctaatctctcttgactctggtgcgatttcgcagctacatgatacattaagtgaggcttttcatttacttgttcttctatctaccactgaaccaactgtgatatcatagtcaatttcagccccagtcatgctatgactcaaaatttgaaattacttttatcctttccttttttgctttgatactcattaaattgagagagatggtcagaggaaaggactactttctgactcatgacataaatatgatgttttaggagatagaggttataattcactgtcctgtttgattctgtgtttttgtagctaattataaaaagaaggaaaagcatatgatagaaacaaatgccccatccatacattatgccatttggaaaagaaaatcagtctttgcaatgagagacaaatagttctgccaagaattaagcaaattacgtgtaatctatgtataatttaggcctttcataaaatacgttttgtgctcttgggcaaagacaacatgcataaagtgagtgcatagagtattataacttggtcatagactgccttttccttactgtctttgaaccttttaatttatgtgtcaaccttgagtcatttgagccatatataagaaaatgatgtttatggcatgttaatactaaaagctgataagtttgcttccttttttgttagctttactggctaattgtattgaatgtaggattgtatctgctctgcagaagtacagtgattggtattaagctaactttgatacttttctggtcagcttgagagtcagccatctggtttaaaaaataatttattgggaaataatttacagaacataaagttaactcatattaagagaacaattcattgaatattattgtacttacagagttgtgtaactatcaccataatctaattttagaacatttccatcatcctaagagtaaaccttgtgatcactttttgtcactcccaatttccctccaatcctcccagccctatacaaccactgatctactttctctcttatgtttgcatttttgaacatttt

SEQ ID NO: 137871 - DNA, 1032 bp, Homo sapiens
gggggaggacgtaggtgctggcagtgtctgcagtgggccagtgggtgggtccattagttctcaggtagggcacactggtgttggcaatgtccatgatgggctaggtaggtttcatcttttattttaatgttttgaaaagcttttttaacattatgtactccttacaaaatatacagattctaaatgaagaaactcagtctctgtccccctctttgctacattactgcttctctgatttatatttttctaagtataagtttttccactggctgtttttaacatgttcttttcagtggaaattctgatatatgttggctttctttattcagcctatagaccttgactgaatgctatatgacaggtattgtgccaggagctgtggtaggaaaactttccatgagaaattagattagcttggcattagatgattatttaaagtaatcctaagacagttatgtgaaaatctagattaaattcataaatggactactaaaatctcaacttagtatatagtttaggttttcacagtagtccagtggatggcctcacaacacaaagaaattcatacatatttcattttagaaagcatatataaaaatctgattgattgattgataggtagataatcttattataatagtcatccaaatcttactcctttttagcattttctgccactgatattgcttatttctcatttctaatagaaaaacaaggagatagtaatgggatgttacaagtaggcagaaaaatatagatgcacatagtttacaaagctcttcaggtcatcttgtaacaaagtcttgatcatttttcttagaccagaagatcaattcagaagttaatagaatgggaaaataacagattatatcacaaggtaagaaattttaagcacataagtgccccattcatatatttgcagcattaaattgaaaaataaatacaaaatgggaatttttaggccacaaaggaatggattagagaattaatactcaatttttaatatatattctttacaaggtatttttaagt

SEQ ID NO: 137872 - DNA, 5580 bp, Homo sapiens
ttgtatcctgtacttttcctggattgttttcagtgatttattcaaatgtataggttgtaattagtttaagttaatataaaaattcttaacaagactatactttcttagcttgctttgcactggaagttgactaagaggaaatgtgaaactagcaatatgatggagtatgtaagtatgaggttgtttttaattatttttttattcattctaaatgtaccattttcctgtgtttatcatttgtcaactattccttcttttttctcctcagccagaacttttgtccattgaaatatagaggttttcttctatcttctttagatttgtagccaacctaaaatatcttgaaagctaacaatcatttggatcttagaaaagtttcagttagtatgctaaaatgaaaacattgtacaaccttaatcatttaacataggcacaaaccatagcatgtggtggtggggaaagctgctgttgaacaaatatttctaaatgtaatcttgtcaaaacttgcataaaataggagttgatatctgcattctggattcctattactggcttttttttttttttttggctgacatttaacttttagtgaagaaactgtaggttctaatttttgttttaactgaaagctatacaatcttagtcataagacataaattcacatatagccaatgtgatcaatttagcataattaacattgaaaatattacatttatccaaacttccaatatgtagtacatatttaataataaacattccatgtgtgtttcataagtaaggattattatggtatctctctacactttgaataattttggggaaaatatgcatatgaccacaagtctaaaattcattatagataaaacattcaaaaatatccgagttttttaaaattatgttttcaaaccttttgtaattaatatgttttactcaatccatttgggcacattaatttttcacaacttgtgaacgatagtaatctccaactaatatcagtttctttaattgaaaaatatataaatctaatataaaggcattttttaatctgtatagcatttttttaatctctactttgctaacaaagagataggggtgtgggggaaaaacataatataatttaatggagtttgctcctgttaacctagacaaatagttattgtaaatcagatagtaaaatctgttagctacaataagtagttttgtttgccagcttaatttttaaattgccaatctaataacaacttgtggtttaagttctttacatatttttttcatgtatttcacttactttatatggttcaggattgaaatattgtcctatgaaaaatgattatagactttctgggttatttataagttatattaaatgaaaaatattttgtaaatatattcttgtttttattttgcaggtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactcctaaagacttgtaaatattgcctctttgcataatgtaaaatgtggtatgccatggtttacataatgtaacattactcttattgtattgccaacaattttacatagattttaatatgaatgaagtttgcaagcatccctttgaatgtagaaactgctaacatgctgttttatggcaaggccataatgagtatgttaagaatttcaggtgtagggcaaggttgccctttgtaacaagtggactaaaattgaaattattatctcagatattctgtattgcacctgaaaccatgacctttatttttccatttcgtttaataatttccattttgttgtctactccttcccacaaaaaaactatttgacatctgacacatttcacagtctcactatcctgcatttattagccttttcttcctttgaaaatacacacaattatgacttttaaggagtattttgagatttcagacatcttcagaaggtatctagaccctcttgaaagccactaacacctttctgcagttctgatattctagtttgagaaagagagagaactatttgagaagctgtagctaaagagtatatagcagctgattcataattgaaaaaaaattctcaattctgtttttgatgatcctttataaaacattaatgaggaaagacaagtgtttagacaaaagtattttagtttataaattcagcacatatgtaacatttatttggtccatatttctctatttttcttcacaattaaaatgattgctagcaccacacaactagaatttgaaaattcagtataatgaaagctttatatcacattaattcaactgcaaatgtatgcctgtttgtaggcattatttgtaattcatagtgctaaaaataaaagtgtctagggctcagtaatattttgtcatcttactcttactgcttttagtaaaccttttaggcaagattcatctcagtgaagtgaacaatcatttcttcatagaaggtcaagcctttttaagccactcttaaaatttatgcctaatttgaaatccacagtccttgaccagtttaaaaaagagaggaaaaagaagacactattttatatgtgattataattgtttgcacaaacacttttccaccttcctctgtgccccattacctctgtgccactcagtcaccccaaatctctaacctttagtaatgtgtatgcctgcaaatattatgtgtttgcctgctgcaaaattgaaggtgtatttttatagacaaggtagaagcctctgaaaatgtataccaaatgtcttgttttgtagctaaggtcgggaaaaattgtatctgaggtttatgttccagctaatgttatcaaatttatgcttcaaactgtgatattttaataccaaaatcgattttcagcataatacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaaccacttgtcagcatgtgtaaacttaattttaaagcctattctaatcactcgagtttattattttattgttcgctatgctggttgactcatcttagtttcttcaactacccaaaaaaataccaatttttttcctctcttgtatgactactttttcaaactgttttcctttgcagggggctgattagcaattgagtattttgtaatgtttgggcggggttgctttgttttcagtgaaattggttgcagtgaatgctaaaatgacacagcacactggtgattaattcctcccccatggagccttttttctgttatgcttaggatagaacatacttgtaattttccattaggttagtaacatacttttgtgaaagttgtttttagactgaagaaagtaattttgaatttctttgttacataatattcctttatgaaacttgtgatagtttccagagcaaaacatgtatttgccaaagtatataaatctcacaaggctttaagattacaagctaaaattgttttttaaaattaatgttccaatgtttctcatttggcccaagattctggcttcataaatttgtccaactggctatttttaagcttgtcctaaaagccaataacatgtttattcctaataactaatatgggcaagtgttatttacagatttattaactccatcccagatatgtctccactctttgttccctcctaatgctaatttaggaaagagaccactgtagtaaaactttagaagaagatggagaagtgccttgtctttttagaacaaagataacacattacgtgtaaggaagcataataaatgaattggtagatgattagattagaaatcatccttttcaactaggtctaagaatactttactagtgtattatcttttatttattatgtaaagcttctttccttccttttccccaatcatgatatattagtgacaaaatattacagaaccggactatcagtcacttaaaaaaacagtataattctaatgctagtaaacatgtaatttaatttagttctggaaggacagttgtctttgattaaagccccaccaaaacccatttaagtatttaatgtacatactattcatattattatggcctgtaaacactaatatctgagcaatcaaactgttttatctaccatttttgatgaaatttgaataaagtttaaaaacgtgtaagcctttgaacaaatgtatgaaagctttaaaagatcattagcacttttattttgtttacaaataagctgccatttaaaaaaataaaacctcactacttgaacataaagctcccaaacaatattgtattaaaatgtactatattgacctaggaggatatagaaattatattcacctgattaactggagcagtttcacatagtagaaatactttttgctaatttgattataagtgctcaaatttattgaaattagattctcatgcctataaaagtatactttaaaaatattttgcaacaactgtcaaattatttgggttcctttaaatagcaaacaattgggaaattttccataaaaatgaataggttttattaatacctgttcatgtagtatgtggactaaaacaattgatatatatctgtatgtaaaaatgaatgatcttatcttgccccaaatttttcttacctgattctgagccagcctttttgttttgatggcaccctgtgagtatgttccattttctgtgaactttgtcaaattcatactatatgaggaaatgatctaatattgtgggctccaggcaggtcatcttaattgcatgtctgtctcttctgtaaaatgatgaggtggaacctagagctggacaaaaaattagagatcacttaacattctgtgattcaaggaattcttaggacatttttactctatagaatctca

SEQ ID NO: 137873 - DNA, 2156 bp, Homo sapiens
tattctcagatctactgtccttggtggaaactctcacagtgccttgcatgcagtaaaagtttgatttgccgactggctgacgtgttaattatcacacagactccaagaacctgatgcttgctagaccttagttccttggtgatgctaagagtaaatgtagttttcctaggaactgagcactgaggtctgtgtcctttgcctgtgtagaatctgtctatgcagttggtattcaggcaagaattttagctgtaacaacaatggaaatattggaggacccactttggcatttatgtaaagatttcatatcctatccaacatttactttagtgtctaatcaaattccataccctcaaaaagatctgttggaacaaattgataaaattaggtggaaaggaaagtggtatgggactcaaatacaagtcacttctggtttaattattggctctgctgcttaattcctctgtacctcacgtcctcattgtcgaagtggggacaataatctggacctacctcacaggggaattgaggatattttcatatattagtgtgctttgaagttgactgaaagatatactggatatcataattatataatttctaaatagatttctttaaatccatgctatgttttctttttcagtcaggtcctacagaatgactattgcacttggtctattgttttaatagtaaattttgttattaatctcctatgtgttaaacgtgggtaattgtattatgttaatacatacttagggaggaaaagcaggtggatgtaaatcagtgattcccaacttcagcagatgatagcagtggagggtatccttgagctttttgtaatatttcaaaaagtatattagaaattatacatttacccataatattcctgcttcacaagtcaattaagacattgaatttccattcattttgcctatattctctcaaaagctgtgaatggcagtatgtttttgattaataataaaataagaaatcctattatgtgcaacttattaaatacttgggaacatgggaaaagaataatgaagggattcttatggtgaaaatgttgggaaccacttttataaaggaactaagattatttgaccccctccacagattgcttacctagtctctaaataatgaaatgtgtgtgtttgtgtgttttggctatattaggctatataacttcaggttagaatttgccttcagttttttttctgttttagaatatcactggcctaatttatttaggtgtgtacatgttgctcatacatacacacacatataggattacaaatgtggaaaatgttataatgtcatattctagcattggactaaatatcaatttctgactcttaaagtagttctgtgtataaattcaacatgatgaatcaaggcaataatttctcaaatgttcttttatttctttgtttttatctcgactttttattttccattttttctagtacgcaaatagtgtaaaattgttttaatgcctggactttgaaacaagtaacaagtgtttgaaagtatataatctacgagcgaatttgccctccttggactaaccacatacaaatatgaatctggctgcaagaacaggatatccaggtaactagagagtgggcattgataaaaatatctggtggagaagcctaggatttcaactttttgtcagaggattcctgttgggacagctttaccagaaaagaataatagcggatatgttcatccaaactaagaactttcatgcatcttgcattgttacatagcctgtggaatgaattcattttttctcccttgagtccaggaatgacttccctggaaaaactcaatctatatacagctgtgccaaaatgaaggatacctgcctctccgaaactttcactgctgcttctgtcattgttcacttgtcagataaaattttattatctcaggatgcaaatttaaaataaagtgtaaatctatgttaatgaattgaattctgtgttttttttatgcatcttcctttcttcccttccctatatgtccatcattataaggcaattaatttaggcttccttttaaaaattgcattttatatctggcctttttccacatatactagtgttaacgttcaatcctgtaagtattttatgctataaacacatgcctcagag

SEQ ID NO: 137874 - DNA, 1029 bp, Homo sapiens
ggagactggcataaagtttactgttatttggttgaaacatttcattctcgtgtgttatacaaatatagtcaactctcagcattcatggtagttatgctctataaagccactgcaaacattgatttagcaaatactgaaccatttcttctagaggaagtacagggttaagttcttgtgagcctctggtcacaaaacgtttttcaaccagtcaatatataaccttgttttatgtgtgtttccgtttaaagccacgttatttgaatatattgttgtttcattaactttgagattaggggcaaaaccactataattcatgcctgaaccaagcttatctaacacgtgtattttatcctcacggcctatcccattcttgcccttaggacccctagacaacacttcagcactatgcttgccagcaatttaaaatagtaaaaccaccaacaaaagaaacaaaaatgtgaaagacatgataggaaatagacaatacaaaagatatttgtttatagtatgagagatgaaacaaaaagacagagtatcactttgttcaacctcagctggaaatgtgcacttcagatgactcacaatttttaccactctgagcatgtttacaaataactgaaaaagtgatgtaagtattaatttggggattacaactaaattttagaaaggaagtgaattttcaaatacagaaaatgtaaatattagggatcagctatgtaataatcttctcaaatagcttcaatatacctaccttgaagctgagggtaatagcactggagagttgggcatgatgagacttcaatgatgtaatcttttataagatttttaaagaaatgaaataaatgtcaacaataacagaagaaaattgaagattatagtaagcaactgagacaactaaagtattctagaaccaactgttgaatctccccaggttatctggtgctattaaattgcataacctagtatcataagaacgttgtactcaaggtccattttccaaaggttattaaagtacttcttgatgtgggg

SEQ ID NO: 137875 - DNA, 1927 bp, Homo sapiens
tattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaatgtaatcacagggtccttataaatggaaaaggcagacaggagattcagtgtcagactgatacaatgagggaaagactaccagcagttgatggctttgaagatagaagaagggggccatgagccaagaaatgtgagtagcctctagaagctgaaaaaggcaagaaaacggattcttccctagaatctccagaaatgcagccctgccaacatggtgattttaactcaatgagatgcattttagacttctgacatctagaattgtgttattttcagccctcaagtttgtggtaatttgttacagcagcattaagaaaatgtacaatgaccatgtgcagtgcctcatgcttgtaatcccagcactttgggaggccaaggtgggtggatcgcttgagtccaagagttcgagaccagcctgggaaacatggtgaaaccttgtctctacaaaaacacaaaaattagcctggtgtggttgtgtggacctgtagtcccagctactctggaggctgaggtgggaggatggcttaaacccataaggtggagattacaatgagccaagatcatgccactgcactccagcctggacagtagagccagaacttctctcaaaaaaataaaaaagaaagaaactatacaatgctcctgtgattctagtgctatgtacatatatcctttatagggaattaaggaggttatagacacaaccagaagaggaggcatggaatagactaatgtataatggataggaaagtgtatcttttacaacttctctgtaaaaacaccttcacctactttatgagtttgcctcagctgccataacaaaatatcagaccaagtggcttaaataacaatttattttctcacagttctggaggctagaagtctaagatgaaagtgccagcaagtttgatttctggtgaagtctctcttccttgcttgccaatggccgctttctcactgtgtcttcaaatgtccttcctctgagtatgtgaggagagagaggtttgatgcctcttcaccttcttataaggacaccagtcctactggattagggctccacccttatgacctcatttaaccttaattacctccttaaaggttctatctccaaatacagtcacatttggagtcagacctacaacatatgaattttgagaggacacaattcagtctataacacctagatggaaggcaatttcatataaagatgatatgcagtctatgacagcaaagtagctagtggaaatcacaacccctaattctatttttatgtcattccctaagtccaggtcccatgtggatatagcattgttcagggctatctctttgctgttctttttttttttttagactcacacaagcaatgtggagaaggaacatgaaaacatctttgagatagagcttaatacagatgtcaa

SEQ ID NO: 137876 - DNA, 1333 bp, Homo sapiens
ctctatcgaacatctactttaaaacagcaaacatgagagcctacaattgacatctcactgtttaaaaaaaacaatttcacatatatattcacaaacatactaaagtggtcaatattcaaagtaaagactcagatattcctcactttgcaccatggtttagttaaataatacaagtaccccaacaacacagtttaaatttcagttaccatggtatattgactgtgatattaaataaagtacaaatttcactgctaggttttcagtatgtaaattactatataactaacagatgtgcatcatgatcaattatgaatcacatcacttctttcacagtctttggtgactggtcacttatcagctattcagtacatgtgcagagaacaaaccatgtgtttgtgttgcctctttgtctgccagtgataaacccaagtgacatttaacaaaaacatataatgaaagagggaattggccaataaaaatgaaagctcaagaaagaaactaaagtcacaatgctggaaatgaaattcaaatcaaaggtaaatgaagttatagaggaaacagctgactgtgggaatgttgacactttcactggttggaaaggctatatagatatgaagccaaaggaacttagttaaagcagacattgacataaatgaggaatttggttgtgacaagcaatgcctattttagaccaatggcttgtatcctcattagggactgtcagtataccaaaagaatgggtgttaagtctaggaaaattataatcatcattaagttgacttttagttcccaagatttcctataattactgttttcagtatttagatattactgctaatggtaaaatggcctatgagtagaaaatatgaaatttacatttctctttatccaaatttcctagtggaaccctgcccctaacaatgtttaccacttcttactgtccattttcacagatatgggggacatgattacatgccctcaacccatatgttttctaggtaactctaccacagaataaagcggtactcaaattactctcagcttgcttaatatccactttaggacactgaaaaacaaacacaaagggactaaacaagatgaacagtacgtatcccatttcttttaagtccactatcttgatatcatgaggccccctcactggttttatgtagatgggctactggaatgcataagctagtgccaattcttattttccaaagatgttaaaagattaacataggatgggaggagagtgaggatcaaaaaatctacctatcaggtactatgctcactaccagtgtaatgaaatcatttgtacatcaaagcccatgac

SEQ ID NO: 137877 - DNA, 3796 bp, Homo sapiens
aaaaaaaaaaaaagttcatatactgaataaccatctgggcccataacagcttaagactttctggagaaaaaaaaaaaaaccagtttccagtttaatttccaacaaagcagtaggaactcttgcctatagaatactgtgctgggggctgggcacggcgacttatgcccgtaatcccagcactttgggaggccgaggcgggtggatcatttgaggtcaggagttaagagactagcctggccaaaatggtgaaaccctctctctactaaattaaatacaaaaattagcctgctgtcgtactacacgcctttaatcccagctattcgggaggctgaggcacaattgcttgaacctgggtggcagaggttgcagtgagccgatcacaccaccgcactccagcctggagacagagcgagactctgtctcaaaaaaaaaaaaaatactgtgctggttcatttgcctataaagtcaccaatctaatgtttgggtatttgatcattcagaattctagaaacactgaagatcccttcacctactcagggtctgggcctctttcatgaatgcttaattcccacagccttacagtttatacccttctcctctcccacttttgatcctcaagttttttgcttctcacattttttactgggtttgtgcttctcagtatccttgaccaaagcaactgatgctgtaagaaatgagacttcaaaccatttacccacactgggtgattaaggtagtttaaaaaaagaaatgaggccaggcacggtggctcccgcctgtaatcccagaactttgggaggccgaggcaggtgtttcactttaagtcaggagttcgtgaccagcctggccaacatggcaaaaccccgtctctactaaaaatacaaccattagccaggcatggtggctcatgactgtaatcccagctactggtgaggctgaggcaggagaatcgcttgaacccaggaggcagaggttacagtgagccaagatggcaccactgcactccagcctgggcaacaaagcgagactccatctccaaaaaataaattaatttattaatttaaaaagaaaaagaaaaaagaaatgaagaacttacggtaattagtgtggttagggacagtgagttagaaattgtcacatcaaaatacaaagttttcaaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtggccagagtggtagaagagatacggagtaggaattaaaccacacaatgttatttagggactaagccatgcccctaacaagaaaacaagccaaaaggaaagtattaggcattctctgggaaggcatgcatttttttcccatgtctctggggccaaaaaccttataccaagtacctattggcacccgaatatatttgtagaatgaatgaatacatgaaaaaaaataaacagtaacctttctcctatattctactttccaagccaattaataagcaagtgtcttttcgtcatgattttttttgttttctgtttaggatttaacaaaatggttgagataacagtcacttctgtttgatgaagagtatcacttcattccatttttgtgtttttgttgcatctccaagtcagaataaatgccttttggagcagatatatttcatttagcatttagtatcatcttcatcaatactcgtatgaacgaaaaaataaaaagccctctcttattcccactctacaacgcatgtcaaaggtgatctgtttagtttttccttagtatcgaacatatcacagctactcaatgaagtttcttctcaactaaagaaacacagtctcttagagaatttgttcctgtgtttccaccataagataaatgagataaagtgcactttggtttacgtctttcaagcacttaagaacagcactttattcagttttaataaatttttactaaattggtaaatgcaaaagaatcttttttttattgctcatatgtcttcctgtctctaagccagaccaatgagcaaatacctttaaaactagttgttacatcttgaaccatttaactgtaataaaagcagaatgtttagttaatgaattaaagaacaaaccctgagcccttttatcagtctcctggctttaaactaagccaatgaggaagtgatttgggggattcctgaaactaggaaaaatgtctctttattttgaaagaaacttgca

SEQ ID NO: 137878 - DNA, 1811 bp, Homo sapiens
tgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgtattttgatgtgacaatttctaactcactgtccctaaccacactaattaccgtaagttcttcatttcttttttctttttctttttaaattaataaattaatttattttttggagatggagtctcgctttgttgcccaggctggagtgcagtggtgccatcttggctcactgtaacctctgcctcctgggttcaagcgattctcctgcctcagcctcaccagtagctgggattacagtcatgagccaccatgcctggctaatgg

SEQ ID NO: 137879 - DNA, 6011 bp, Homo sapiens
ttttttttttaatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcatttttatatcctagggcatgtagttccgagccccacagaaagtaatcaccattcagtaagccaatagttcattcctatctgtatagaactgtaggctttgtaaatctacacatagatctctgttgtaggttcaataatgataataaatgtttgtgcccccagttgttatctctaaggataagagtaatcaatgatcattcagcagatatagcttatatatgggtggcagtttacaaattataaattgattttacacatattttcttctgctacccaagacacaataaagatggtttatctttgcatccccaatgcctagcaatgagattggcacacaatagataactactatagtggcattcttcagacaaccaatcccttgcgtatgcgtattcaaaagataatcattgttattcaaattttcctactttatttgcacaatataataactatcatacaattttataaacctagtacccagcaccaagtgagaaaatcaacagttacatttatatggtgccttagagttcacaaaatgctaacataggtattgccttatttttggctgtggctaaatgaaatatgataaattttcagtgcctttaacagtgagttcacatagtaggcaatcaaaattgatctatttaacaggtatttaaacccttggtttgtataactacttatagaacccttctcactgtggtttaactatacaatgagaattttgtagagacaatacctagcttacagaaagttttattcatacagaaagcatcaaatttttcatttacaagtgctttataatttagaaagcacattcgcaagctgaattaagtgactttcggtctggatctcacatctattacttcatttcctcatactagctctttcctggttacctggaaaaatgtatcagtaataatttaacttaacctcaccagtaaagtcttgattgtttaaaattaagcaatatatcattccttacatctgaatagtatagaggataaactttcctcttattacataggagaattaatcttgtattttacagtacccaaaatagctggtatgtaagaggcacttaatattcattcatccattcattcattcataaatatgtagcccattgacatttgtatcatgctttagtttacaaagcactttaatatgcacctttctgaaattttttgttctatgagaatacttttccccctttggtagctctagcacccagcatggtatctggcacattataggtgaccacaacaagcttagtcccttatgttttcagtatattttaaagtttaaaagcagtttccatgtgttttcgtttctgatacctggaatactgcatttttactcaaaattaccagagcagcaaacacaaattggcctcaaatatacatataatttattcatttatcaaacaattccttgtgtctgcatagtactatatccttttgaaagagcacttttttatgcttgctcctttctttgtatccacaacgcttatcacagtagaatacaagtgctttacagtttacaaagcacattcactattttttttcaggtcacctagatatcaataatcattgcatttttagtgcctagcacagggacaggcacagaaaaggaaactagtagtattcagaaattttctctgaataacaaataatacatcagggggtggtaagctatgaacagcaggccaaatccaattggctcaaaaactaagaatgattttgaccttataaaaacgttgtttaaaaaacaaatatgtaacagaaaccatatggcccacagtctaaagtatttatgatttgaccccttacagaaaaactgtggacccctgatttacataatgcttcacaatttacactgcactttcaaatgttaactgcatgattgccaatacactaattggtttttctcttatgttttacagtgctttcatacacattatcagtcatttaaatcaacttcccacataaacaggaagaaaaaaatcaaggaaagtattaaacatgctcaacagtcccaggttctctcatctttaagcctagagatgggtattaaacccaggagtagcgttggcacagtccaccaaattatttggccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaaggtgagtagaaagggaagaagcagagaacaaatacaagccaacagagattaatactgaaatagaaaatcacaaacagcaagagatgctgaggcacgcaggggaggagagagagaatagcccaagagaggcagaaaggaaatgcagaaatgagaaatgtgagataaaaagtagaaacagcagaaaggaggccagactcagaaaaaaggtgaaatttaaaacgaacgagaaggggaaggggtaacaaataatcacagttcacaaagagaaaagagaggtaggcagagaaaggagaggtagacagaacaagaaaaggacaaaaagcacacagcatgtgacccaaaaaggagacatgaaataaagcgtgaaagaagagccacatctaggagagcaaagagaaatagcaacaaaatgaaaaatgagagatatgtctaagacaagacacagaccactcttgtgaacaaaaagagaaaatgaggcaaaggcacacacgaaagaaattagcaagagaaacatggaaatgggtaagacacactttagatagagaacaaagagcaaagacaagaaagaaagagacaaagaaatacacacttgagtgcaagagataagcaaaggcagacattcagaggaagtaagtagtagaagaggcaagatacagtgaggggcacaagaggcatgaaaagcatcacagaaagataaaaaaaatcaaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagagctataaaaaaacatgagataaaccatgtaaatgccataaatattgagtactgtgctagagttacataagattcaaattaataagcaatagaaaatg

SEQ ID NO: 137880 - DNA, 4835 bp, Homo sapiens
ttttatgaaaatacttagtcatctgtgacatcccatttggctcttccagaaatcctagtaaatagttgtaacaggatgttaagaggcatacattgtgtgttttaaatcctctgctactcattaggtatatgacctttgacaacttaaagtctctagacttctctgtttgtgagggttaaatgaaatcatgtatgtaaagtgctcacctattgcagtgcctggcacatgtcaagtaaaaggtaacccaagaagactcataagttcatttcccacaatataagtgaccactagcactatcaggtagcaggcagagttggcatgctttggttctatgtaagaaatccctaaggtaaaagtttataaatagaagagcatctgtgttggtattggtggttgttattattgtagtactataagtagtattcgtagtaacaatagtttattataattactaatgacactttttgattttttttatctttctgtgatgcttttcatgcctcttgtgcccctcactgtatcttgcctcttctactacttacttcctctgaatgtctgcctttgcttatctcttgcactcaagtgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagat

SEQ ID NO: 137881 - DNA, 1880 bp, Homo sapiens
tgttgtattatacaccatggcatcccaagccatcctgaagtatgtaaatgattggcaaagttcttctgtaaggctttaagagagactttggggaccacatggaacagaatgatttgcccatgtgatcaatgtcactgatgtgacagttgtccatgttctcctaaaagaacaacttagctgtaagcctctgccacgtgctatagtcccactccaaacacccgaacacatgcaacccgctaccctctttacatcatcactttaaccagttaatctcacacccagttgcttcccaggttagttaggaagctgtttttaccaaatcatatgcagaataatgatgaatacgacctcagtgaaacactaagtgcaatgtatactggaaaacaaaatcaaaattaagactacttattatgcttttagggacagcttacgcaccttgacgtgtggtggttgtttttgagactttatcttcctatctgggaccaggaaagtatcttgacagaacctcctgacctagggttgttgcccagtggtagtgagcttttcccctggaggatcctcatgccccatctccacctagggatcgtcaaagggaatggatcactaacactgtaaaacaacaagcctattcttctgaggaagatctgaaaagagataaaagaaaaagtattgaaatgcagtacactgggaaagtctgttctaatgggcaactagtggttgagttcaaccatatttttacccttttcttcatgtggattgaagagtggacatttacagttgtgcggagctgttatattctggctaccaacttagcaaaaaaaaaaaaaattatcctattcattccagctctattctgtatgctttccctcatttccaagagaaatttagaactgagtaattgccaatattcccatgctgcattttattctccagtctttattactgagcgatcctctacaatgtgggttgttaatacccttgtgttctcagcacaaaatatagtaggggggtcaagaaatcaagaggttgaaactaatggaaggagaaactaatgctttctcaaccaagagagccatgaagccacacagaaaaggtcggatgtggtctaaccctatgagttatgtaagaattctcctccacaatgcctctggcttcctttataaagagctattttaagaactgagaaatccacctctatcaaagtgcctgtcagctagttctgtagcatccccctcttttaatttgtactttaagtagtgccatgccataatattgccaagataaagagaattgtttcctactcaatccacatggtaacatttcttcaacaacctgtataatagggcgccaccaaagttctaggatattcggagaaaccaagaatggtcacaagcacatagaactccagttataacaacagctggccaggcgtggtggctcacgcctgtaatcccagcagtttgggaggtcgaggcgggtgaatcacctgaggtcaggagtttgagaccagcctgaccaacatggagaaaccccgtctctactaaaaatacaaaattagcctggcgtggtcgcgcatgcctgtaatctcagctactcgagaggctgaggcaggagaataacttgaacccaggagacagaggttgcagtgagctgagattgcgccattgcactccagcctgggcaacaagagcgaaactgcgaaaaaaaaaaaatacacgccacaaaaacagttaagcaaatctatgcagaaggaaaaacaaggtacagaaaaccagggattcagtaaattccttatacaggcccccggggctctcctattccactttttaacaatttcaattgtttttcaagctaagaaattttgatttcttaaaacaagg

SEQ ID NO: 137882 - DNA, 1090 bp, Homo sapiens
gcccttacagacctcactggagcccagctctgagggataaatgaaacaggccgaactcattatgtaaagttaaaatgtatgtgtacatgcaaaagaaaaagtataggaattgatgaaaactggctcacgttctgcttttctttctttttaagagactgggtcccgctctgccacctaggctggagtgcagtggctaatgatggctcactgcagccttgaactcctgggctcaagcaatcctgctgcctcagcctccagagtaggtaggactacaggcacgtaccaccatgcccaactaattttattttattgtagagacatgggtcttcaactcctggcctcaagtgatccccccacctcaacctcccaaagccctggaattacaagcaggagccaccatgcccagctgtgttctgctttaaaaaggagagttgtgggaagttcaatccaaagacagaagcactacaacaataaattccccaaactacctttttctccagatagctggcaacccatccaagtagattagctggagcttggccagattctcaaagggaaagatatgattaatttggagcctcttatagctgtttgcagtcctcaggtctcacatgctcagaatgtccttaagaagaaagacagggttcagtaggctaccaaagcaccggtaggataccaaaagagttacaaaaaccccaatgaaaaaaacctaggaagtataaactgaagcattagacataggtatctcctgtctctactttctagcctgcttggtctccctaaagtcctctaatgacaagccctggcagtacacgggaagattagacaagtgaagaaaaagaactacatgaaaatatgggtcaaaccaataccgaccttaagggctgacactaaatttgtggctaatggtcatcctgttgctgaaaatacttcaagattcaaggtggtgtggcaactgctactactgcttagaggtgcaattgtcttgactgtttttaataattggctatctacctttactatagcataggagctcactaaaggggatctaagccaaatttgcagtcttgaaagcactttgcatggtact

SEQ ID NO: 137883 - DNA, 2783 bp, Homo sapiens
aaagaggatatgagaaaatggtcagaaaacttcctccaatcctacatgttaaggttttataaagggaaaagtcagaaaagaaatgacaataatcatttaaagaaatgccaaaaaagtttccttcattagacttttgaaaattttccaaatcacaaaatgtcattttcagggatttaggtatttgatataagcccctatcttatttcactagcagtctcgagatggtcagattgatggtgatctgaaccaaactcagagccaggactaaagtctaagcatttctgcccaaaaccataatgatttccttctgcatcctccataagaaagcaaattccttgatataaatcctgtctttggttttgctatttattccagcacctggtacaataatatttgttgaactaacacaagaattatctctattttgaagatgcccacatttccagagcatccctttttacaattgctagagatttttcttaagggtggaaattatttcaagcaatgaatttaaatacagcttcaagattcacctttggatgctatctagtataatcaatccacctaaaatcaagccatccttcctcttgacttaaggtacagaatcacctccaaattcattcatttaaaacaaattccaataataattataattgtatgttgacaatgaatgacaatttaattaccaatagaagatttcataagcatagaccagggtttctcaaattggggtgataaccctggggatttgtgaatatattctaatggatccccaagttctacataagttatataaaacacatctttgacaaagacaacgtgaaattggaaaacatatttacatttcaaatatctttgttaagtcagtgttcctcaaaacacatttttttaggatctcagaaaattttgttcctttagaaggtgtttcatcatgaagcattacttgggtttgagaaacaatggcacagaccatgtttccaagaaggttcaagaccatgatgtatataaccctcagtcagccagacaatgttgttaagcatatggagtggggctgggaggcatggaaacaagccctgaggaaatatggatatgaattaaaacgggctataagtgaagccagttcacttatatggttcttgttgctcctgctgtgatgcatgaatgtgcaccagaaaaaaagtttcgaatgttatgttaaacaatattttgtcagctggaaaacattaaggaggctaagcttcttttagctttacgaaaggtgggaggaaagaaggtatataaactacagcataaagtaggcaaggaaggtcaaggttttgacttcacttctccactaccctcttggcaaaaaggttccaaacttaaaaagtatctacgatatgcattatccatggtcatctgttcttgggcagaaatgtagtaaaattgtggaaggagccgaagtattagatttatgccctcaatctctgaactttaaaatactcaagcttatgagatttagcaatcactaatttgccaaccttcgcaaatagccaaacacaatggctatgctctatccctttcatctctttccatggctccaaaagaggtaaaaaacaaatgaaattaaaataaaccaactggactatccagatggctgcaatattaatcctatcttggcttaaagagaaaaagcaaacccacttccttaagtttattctatcaacttcaaatccttgtgggttcccttcctaaaactactacttatgattcacacaaaacagcacttattattttctaaagttatttcaaatgtgctcacattagctcctcaacgataaaatcatctcaggaatgaaattatataggatgatatcattcctacccaggttatcagtgtaacctagcatagagctgggtccacaatattaattctacagttctgctggttaactcacatatgtgtatttatgcatgtatgtatgtatctatttctctctctatatatatatattgcagatgaggtgggaagaaggaaagaaacttactggaccctctgacttttctataggtggcatctaagagaaagaaaatagaataggaaaaagattacttaatagctacgaagtagtacttacagtattctaaagagccagagactcttctttacagctgtccgaggagctagtagggcaaactgctccctgagctgggccgatcttttgacatccttctccgagaaacaatattctttttcagttattacaaagaactgctgttgtgatgactagttatttgcttgagcagttccatattacataatcctgtgccacaaaacaccctgtacactagtggctgggatattattcatttccactaggcagctatctcactgttgaaatttatatccaaaagaatatttaattttggcttatttttcttataaaatagggaactcgtcttatcatttttaagtcctcacctcagtgtggtacttcaaactacttcaaattattactataattaaatgcttcattttatataataattaataaaaaaggtggcatatgctttttaaaagcacctctgcatatgttccctcatttaatcgttttactgcaatcttcttgaaataagtaggggcaggtgctccagatgaagaaattaaaggattataaaatttaggtagtttttctaaaagtgaatgctggtaaagcccacacaaagatactggtcttaagagttccactctagaatatctttgatattaaaatagcaagagtcagtgttctatccacagaccc

SEQ ID NO: 137884 - DNA, 3575 bp, Homo sapiens
ataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgtaagtactacttcgtagctattaagtaatctttttcctattctattttctttctcttagatgccacctatagaaaagtcagagggtccagtaagtttctttccttcttcccacctcatctgcaatatatatatatagagagagaaatagatacatacatacatgcataaatacacatatgtgagttaaccagcagaactgtagaattaatattgtggacccagctctatgctaggttacactgataacctgggtaggaatgatatcatcctatataatttcattcctgagatgattttatcgttgaggagctaatgtgagcacatttgaaataactttagaaaataataagtgctgttttgtgtgaatcataagtagtagttttaggaagggaacccacaaggatttgaagttgatagaataaacttaaggaag

SEQ ID NO: 137885 - DNA, 1493 bp, Homo sapiens
tattttgcacagtaaagcagtaacacaggtgggcaagaatggttcttgtccccagaatctgacaataattgaaactaggatcattaataaatgaaagaaaatgagtgaaggcttatccacctagttcaggcctgcttttcatagtcaacactgcaccaacacaccaaagtggtagggagatcttggactgatgggctgaaaaatgggacaatcagtactgtgtttattaataacacagaaggggctttgggtagtcagcatactcagaagcaatgcgaaaggaagtagaggggttcatgtataatgggtgggaccaaggaaagtgcaactgagaattgtttaagtccaagagaaagggccttgtctggtcaacattacccagcaaagaggcaaaaggggcagggcagagggaagggaagagggagacagcacaatcttacctaatagctgcaaatatggacacctgagattgtgagcaatagtctgtaaaaaggggccaagggcacacaaggggcagagagagggaagacttcgtatataaagcatgacaccatggctacctgtgattttacacactggcgcaatgcaaaagggttgggagtatggaccactgtttgatagacaagtgcatggaatactccaatgcttatactttattatgccatgggaaactaagggtggggtggggcgcttgcttaacaaggtcagggagggagaaaaccattgataactgccattgtgcctattaacagtcccaggagaagttttgagtagtcagcagcccctgcagtaatgcaaaggggatactagggcataatatcccactctaccagaaggagacatatataattgcaaatattcacattaacagtacaaggggccttagtgggtcagtacccccgatgtaagcaacgaggaagcaggagtcttatctaatgatcagtgcccttgataattgttattaatgctattaattgtccaagagctgagattatgagtagttaacacttctcagcagcaatccaaagggtaatgggaggaacatagggtctttttctcctacacaggtccacaaatacaattatgacattaatattaaaagaaaagggttcattcataattaacatgcccctgatgcaaggggaatatgtggagatcaactcttagtctaaaagaagaggtggacaattgcattaatgcatattaagtccaaaagaaggggcacttagtgaatatcatccccctgctctaaagcaaaggtggtacaggaacatgcttagagaattgagtttgtgcacatgaacattccaagtgacagtcttgagtagtgggcactacctgctaaaaacactaagaaagtaggtaggatccttatctagtgcacagatcaggagcaaatgtaattgcacatattaacagtccaaaacaacaggactttggttgatcaggacaccctgttgtactacaaaggaaaggtgatggggtatgacctt

SEQ ID NO: 137886 - DNA, 1091 bp, Homo sapiens
taatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctcc

SEQ ID NO: 137887 - DNA, 1092 bp, Homo sapiens
ttctgtattgcaaaaggggtcggagagtaggaccttattcacatggaatgagcagtgtgcgattacgcacataaatgtccaagatgcatgcttgtggtcacttacaattgtgcacctagactctccaaataaaagggtcttatggggtgggcacttcctgctggaagggaaaagtggggatgaggggagcactttccttctctagtgcatagcaacctcgacaaatacaatcacacatattgggaggccaagaaatggggccttaggtgtcaccaaccatgctgtccttcaaaaggaaggatactgatgtaattgtcattaggcacattaacagtttgagaaaggggccttaagtgaatagtaccccatgcaataaagcaaagagggtgtgataggtcagaaacccaagtctaattgaaggaccattgacaactgcaattacatgccatctacagttcgaagagaagggcttaatattgattagcactctctgctttgataagtacaggagtcctgataaaaggcacaactgtatgcaactgaaaatgtgtatataacacctaagattatgcacgctaactttactagtctaagggtcttaagtagtaggtacttccagctgggatgtaaatacagtgggtggggtccttacatggtaaaaaagtacagcagcaaatataagtatgcacattaacagtccaagagagtgaattcaggctagttagaagctcctgcagtaatgcaaatggagcaaggaagcgggattctactctaacataggggcacatcaactactgctaattatgcgcatttaagcagtataagagaagaagcactagctagttagcactcctgctgctttgccaaggaggtgtgagggggatgggattccagggcaattgtcttacttttttttttttttaatgttggccaggctggtctcaaactcctggcagtaagggatcttcccacctcagcctcccaaagtgctgggattacaggtgtgagccaccacacccggcctcagggcaattttgcataatagaaattcaagaaagactttaggaaatcagtacccccttctatgatgct

SEQ ID NO: 137888 - DNA, 1068 bp, Homo sapiens
atgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaa

SEQ ID NO: 137889 - DNA, 3824 bp, Homo sapiens
gactcctggtctagaaatgaagtctacttccagttaatgttctttctggtatgtctttgctttcttgaaatttcccttttttgtccttactgggtaaattttgaaccaaccaaatcacaaagatgtccggctttcaatcttctaggccacgcctcttatgctctctccgccctcagcccccccttcagttcttaaagcgctgcaattcgctgctgcagccatatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctga

SEQ ID NO: 137890 - DNA, 4451 bp, Homo sapiens
aaagctctcaattgacattccctaacttcaacgtaccgagtaaggaaattctttgtcctgagatcacagacaaatgggattgtatgcattaactgaaaatggtcaaggagtcagtactgaagatcagcaatgccaagggtaaacggaatatcccagtataataggataagcaatggacaacttattttgagcactgaatcaatgaaaattagagtgactttcgagagaagctgggcgggactgaggaactaggactgggactggggctagggctggggggttaggggactggggctggggcagggctggggcggggtgggagtagggctggggctagactaggggtttgctgggagcagggctggggaggaactggatgctaggcaggcaggatacaacgaaaaattgaaatactccaatataataagtctgaatagaggacaccagaccacagcaattcaagtttcctgtctgataagtaggtgattagtcaattagtgcagcatcaaggatgggaacaaagcaaggcctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttggccaacgatcatctgtgatccattctggtccttgccacggctcaccaccatgtccacaccaagcaggcctggagcactgcccatggcaacagtgcagtgcagggcagaccagaggggggtaggggggtaggggggtaggggggtggggaggtggggggtggggggtgggggtggggagttgggggggttggggggtggggggggaggtatacttagccttaggtgaggcaccaatacagaggaatggagggaggttcagaccacacagccagatatccagcactgcaagaggcagcactggacaggaggggacaaataagaggggacagaggtggaaaggctaaatgtccttgaaaagaccttgaaaacacctggtgtaccgcccactgggagacatacacgtggcccctccacttctttctcctgactggctaaagacagctgcgaagtgccatgctaattcacccaggtcttcgctgagtagctggacagtgtgtcatcagtctaattccatcttctgctctaattggctgtgatcaattccacccccatttctaattggttgggttatgcagcaatccagcactgtccatcccaccttttctcccgctctgcgtggcactaggcggcaaaacccgccatctttaacaatgcggcaagcccgccatgatgtccacgtgacaaaagccatgatatacatatgacaacgcctgccatattgtccctgcggcaaaacccaacacgaaaagcacacagcaaagacaaagaggcccgccatgttttacactgcggcaagaccttcagccgccatcttttcctgtgtgaccgcacatgtccaccaccatgctaaccacttaacaaagcctcgcccatcatgatgtggccttcccgccacttgaacactgcgacagaactggatccgccattttggacaacctaacaaagcacagcccgccatgctgagcaatgccgcaatgtcaaaatcgccattttaagccctgcaccttagtctttcctaaccttccatttttaactagtcccttgtactgataaaagatgattcttactgcctcccgatacaacaatcacgcaaagctcctaacaagccccaaatcaattcattcagataggtttagctcatgcaatgcacatgacttcctctgcctgacctgctatcatccatcttgcctccctagtttaacttagcacaaacgactagccctaagccgagttatgcggcaagtctaaaatggcggccacttttcctccacaatctgaacacgcccttagcttaactgcagagtcattctctgccaaagcggtaggtacactcacacaccaccaaatgatcagcagcaaaaaaaagtgtagatattccagagagtgcaacaacccacaaaaccaacattttttcatccataaaaagcaccgatgggcgatgaaaaaaaaaaatcaaagcaggtatccgcggccccgatgggccagaaaaacaaaaattaaagcaggtatccgaggccccgatgggcaaggaaaaataaaaaaaaaaaaagcaggtatccgaagccccgatgggccaaaaaaagaaaatttttaaaaagcagatatccgtcaccccgatgggccagagtgttgggggttcagaggggaagggaatcagcaggtatccgataccccgatgggctaaggaaaaaaaaataaaaagcaggtatccgcggccccgatgggcgaataaaaaagaattaaaaggcaggtatccacggccccgttgggcaaagaaaaaataataaaaccaggtatccgcagccccgatgggcaaaatatagaaaagagagtggaagagtaaaaaactgatccacaaaaaacagagatgtcaaccaaaaatgattccaaagaaaaattccttaaatattaaaaattgcctcaaaatattccaaatactttctttaaaaaaatatggaggacgtgtcaagaagacactaggagaaagtatagaatttaaaaaaatattttatggaatttaggtgatttttttaaagaaatacgccataaagggtgttgggggactagaaaatgttctagaaagaaccccaagtgcagagagatcttcagtcaggaagcttccagccccgagagagtaagaaatatggctgcagcagcgaattgcagcgctttaagaactgaagggggggctgagggcggagagagcataagaggcgtggcctagaagattgaaagccggacatctttgtgatttggttggttcaaaatttacccagtaaggacaaaaaagggaaatttcaagaaagcaaagacataccagaaagaacattaactggaagtagacttcatttctagaccaggagtcacaacttcaatgggttttccagttctcatctataacatggggacattgagtaaatcaagcaataattaatgctaaaatcctccataaactgcataataaatgtaaagatgttaattcagcttggttttgagaatgggggaagggataggtagagctttgatgtgttgataaagtatccaaatatatcattcaaaccagaatttgtaactcctccaccaaacttttgaaccaaagaagctagaaaggagtaatacattgaggttagtaccatcttcaagggacttcccattccattatcccatgtaatagataatggaatatgtattgcatagataataataaaggattattcctgttttatacattaaaatagagtcctatagaggttacatcatgtgcccgaggtcacacaccatgattcagagtcaatgtagtttttactccaacactctaccttgtatggctcccaaccataagagaacggaagtgcttacgagtcaattggtgagcaagagagaaaaaggaaagaaagacatttcatagaatggctatttggttcctaaataatcaagaaagagtactgtttgtgacctgtttgtaattttttaactatgactccttaatctttactattttcctatttcctccatgaatctgaggaacccaacattggaccaaccatatgacacagtagtgaagttgaccctctgtcagtaactgataagtggtaggaagaaaaagctcatataaaagccaaagctgccctcagaaacctggctatttcagtaggaagcaattaatctcataaactcttctatgtcattcgagaaacaacagagaaccagaagggagacaatggcaacttaagtattatagagcaacttctagaaagtcaaaggatacattaccctcccactggctgaactggaaagtgtaactatcgacccaaatctatcaggtaagcttgctcttcagtttccagaaaaataataaagtatgcaaattttcttccttaagaaataccttccatcttctaagtgtccttggatcaaacaaaaaaagtaatctgacttgtcattccaaatgagggtt

SEQ ID NO: 137891 - DNA, 1289 bp, Homo sapiens
ttcaatattccactttcaacattgaacagatcatccggggagaaaatcaataaggatacattgaacttgacctactttagaccaaatgaatataacagacatatgaaacatttaacccaacagcaacagaatacacattgttctcaatgcacatgatacattcttctggatagattatataataggccacaggccaggcacaatggctcatgcctgtaataacagcactttggaaggctgaggtgggaggatcatttgagcccagcccagaagttcaaggccagcctgggcaacatactgagaccctatctctaaaaacatgtatgtgtgtgtgtgtgcgtatatgtgtgtgtgtgtgtgtgtgtgtgtgtgtgtgtgtaataggtcacagaacaagtcttaacaaatttaagaagactgaaattatatcaagtatgttttccaaacacaatgttataaaactagaaatctgtaacataaagaaccatggaaaattggtggaatttgcggctttggcagattgaaataatggcaggtccagaaagtgatgcgcaataccagttcactggtattaaaaaatatttcaactcttatactctcacaggtagaatgaattgtgtactggtcacatacagaagcattgctttgattgtcttatatttcaagttaaggtccaaaaaaactccagctatgaaagcaacataaatggattttaaactgtctacagttcttaatctcatctgttaagttcccatgcctggagaagctaatgccaactcatcatgtgataattcaatttgtacaatatattatgaacttggaaaaaaaagaacatggaaaattaacaaatatgtgaaaattaaacaatatgctcctgagaaaatattaatattagagcaaagaagaaattaaagaagaaattttaaaatatcttgagactaacaaaaatggagacgcaacataccaaaacttaagagatgcagcaaaagcagttctaagaggaaattttatagcaataaatactaaaccaaaaaaaaaaaaaaaaggatctcaacaaaataacctaatgctacacctcaaggaactagaaaaagaagaacaaactaagcccaatgttagaagaagaaatgacaaaacaaaaatcagagcagaaataaatggattagagtctagaaaaacaatagaaaagatcaatgaaacagtatttttgcacgcattaaccaaattctctttatcccctccttccccactcccactcttcccagcttctggtaaccattaatttactc

SEQ ID NO: 137892 - DNA, 1031 bp, Homo sapiens
gaagctgggaagagtgggagtggggaaggaggggataaagagaatttggttaatgcgtgcaaaaatactgtttcattgatcttttctattgtttttctagactctaatccatttatttctgctctgatttttgttttgtcatttcttcttctaacattgggcttagtttgttcttctttttctagttccttgaggtgtagcattaggttattttgttgagatccttttttttttttttttggtttagtatttattgctataaaatttcctcttagaactgcttttgctgcatctcttaagttttggtatgttgcgtctccatttttgttagtctcaagatattttaaaatttcttctttaatttcttctttgctctaatattaatattttctcaggagcatattgtttaattttcacatatttgttaattttccatgttcttttttttccaagttcataatatattgtacaaattgaattatcacatgatgagttggcattagcttctccaggcatgggaacttaacagatgagattaagaactgtagacagtttaaaatccatttatgttgctttcatagctggagtttttttggaccttaacttgaaatataagacaatcaaagcaatgcttctgtatgtgaccagtacacaattcattctacctgtgagagtataagagttgaaatattttttaataccagtgaactggtattgcgcatcactttctggacctgccattatttcaatctgccaaagccgcaaattccaccaattttccatggttctttatgttacagatttctagttttataacattgtgtttggaaaacatacttgatataatttcagtcttcttaaatttgttaagacttgttctgtgacctattacacacacacacacacacacacacacacacacacatatacgcacacacacacacatacatgtttttagagatagggtctcagtatgttgcccaggctggccttgaacttctgggctgggctcaaatgatcctcccacctca

SEQ ID NO: 137893 - DNA, 1199 bp, Homo sapiens
gtgagacttacttcataaatccatacctttttaatgtggattggagagaagttgttgcgctgtaatacctctgttgctactgtgagagtcattgccagccactattctcatgtcaagctgcccttgaggaggtttctcttgacccaatttagaaacaacccaaaacaaggtttgtaacttagaggaattctttgattctgtgacaaggggtctgtgaccctcttaaagggatcaagtacacaggagatagtacaagtagtactaaatagccagcttaaaaaattggataggtgagatgagacaggaacagtggacagaatggctctaggcatccccaaacaccacatctgggataaggaaatagtacaatggaaagtctatccttggacctactatttgtcattccccatggcatgatggaatatctaaaataaaaagagttgctttggagaaggattgcaaaatattatttcatagaagagatttagaagaggggaaactcccaattacataaggtgggcattatagcttctcaaaacattggttccctatatgggtcatgaagattgatcccagtatcagcctatggcttactaggccagtttaactgaaagatttaatgagcttggaaggatgctgccacctgcactctcactttggcgggtgtttatcaccagtgagtgcggtccctaaaggagcaaaaggacaataagcacccagtggacaacagtgtggcattttgagtgaagatagcaactgaaaaggtcatcggcttggctagattgggctgggcttgttttttaaaaataaaaaaaaagttttccttcatgataaaagtaacaggtgatcattgttaaaaaataaagtatgaattaaaaagtaaataatatgtataattttataagccagaaaactaatttgtaatattcaggtgtatgtcctttcattctttttaaaaattatgtatataacacagttttataacaaaattgacatcatattgtatatatcattttattatctaattttttcatttgaaaattcacaagcatatttccatgttattgttctttgaaaaatacaatattaagtgctccataatatcttatggatttaacaaagtttatttagatgatgtcatgttattggacattttgattattaccaagtttgcgtataaaatttaaatgtaatgaaca

SEQ ID NO: 137894 - DNA, 2149 bp, Homo sapiens
gaccagaatggttagtgatgagattttatgtaagtaggactgggtttttcagggggccttgtgtaacttgccatcaagagttgggaaaggaggccctgagcagtgcagcagagctatgtaaagtgagagtttgggtcttgggaccaggtagcctgggctcaaatctgctctcacacttagcaatgtggtcttgagcatgattcttcacttccccaggactctgttttctcttatgtaaaataggaataatatttattttcaatgatgggggtaaaaagtacttaaagggactaattatgtaaattgcttagaacaggcctggaatatacagctaaatgctgtgtcaactgttgttgctgataatggtgttgactatgacaagtattaaaagaagagatttgactagaggtacttatattttgaatgatcagtgacgatgttagggttgagaaagaaaaacagtaactgacttgaaggttttcaatggtatgtaagtgtgaggtcatttcaccttttatttctctgccaggtagagtgggaaaccaaattaatcactccatgatctagtgactaatctattgcctttgcttttagttccaaatagaaagctgttgaaaagttgttgtattacacctgcataaaggttatcctgaaaacagaaaaatgcattagactttgtcaaaactggatttgaaacctaattcaactgcttgctggctgtgtgacttaaacttgttgaacttcagtttcttcctctaatataactattaattttcagagtttccatgaagatatttgtaaagtgtttgtcataggcactctatacattaattacagctattattgttagatcttgggacacccagcacgtgacaaaaacaacagcagaccctggtgcctgggaggacttcatggatccagcagcaacctggagtggtgctcctctgaagaaatcctactcggatggatataatacaacctgctaagtgtcctagcacttagcaggttgtattatcattgtccgtgtctatggctctcgtctaccagactttaaattccttaagggcaaggacagtgccttactcatctttgtattcacagtgcctaatccggtgcacattgtaggcctcattaaatgtttgttgaatgaaaaaatgaatcatcaacagacattaattgggcgcctgctctgtgatctccatgggctcagcttgtccccgccagttgccaacaacgtccaagctctcttcagaatgcttactcctgaagcttattcctgtcttctaattcttttgttgaggacttttctgtgtagtgcaatgatagcaaatacacttcatctcaagtaccatctccaattgattgataatgcctgccctgattatgttttataacaagattctgaaaccaggtcttatctcagtgtgaaagacatttataactatttagtgatgtctgctgagggtcggagaagggggagtagcagcacaagtgcctcatatgtcatatttgctactctgttttctatgaaatacttcatttctatgcctgcattttggtcttagctacttgctgatgttgcatggctgttgctgctactgtaattgctgctaattgctccctgggttggaccagagtgctcattgtctgaacagaaacctcatcctcacagtctgaggtttgctcctgtggctgatatttaaagttttcccctttcaactttactccagctatccccttacctgcactgacaggtaatcctccaccgtcctgttcacctctcaccaggttcatattttctttatcttatttattgtacttaatcattattttgtgagaagcttttctgattgtagatgtgacaaccagaatacaagttaaaaccacttatccagcgccttacagtgaatcatttaacatgagaaaaaaattgagtgtgtttgcagaccatggggcagaaggaattgagaagggagtcattgtagatgtgagaaagagagagatgataatagatggaagatgatcttgaaagatgatgcaggtgaagctggaagggtgaaatttatggctctagaacacatgcaggtggagggttagccttaggtaagtggaactacctctttgctggagcacagagatagggatagga

SEQ ID NO: 137895 - DNA, 1048 bp, Homo sapiens
tcttttaatttttgtgactcttcaaatgccataatttctcttttgtttgtgaaggatagttttgctagatacagaatttgcagttggcattctttttactttagcagtttgaaaatatttcccattgttggccgggcacagtggctcacacctgtaatcctagcactttgggaggccgaggcaggcggatcatctgaggtcaggagttcaagaccagcctggccaatatggtgaaaccctgtttctactaaaatataaaaattagctgggcatgatggcaggtgcctctaatcccagctactcaggaggctgagatgggagaatcgcttgaacccgggagatgatggctgtggtgagccgagatagcgccgctgcactccagcctgggcggctgagtgagactccatccccgaaaaaaaaaaaagaaaagaaaagaaaaagaaaaaagaaaaaaaattatttcccattgttttctggtctctgatttatgataagaagtcagctgattatcttattgaagatcagttaaatgtgatgttttttattttgttttttctcttgctgatttcaaaatttctttctgacatctggctttgatgatgttactactatgtgtaaatttgaatgtctttgagtttatttttaagacagggtttggctctgttgcccaggctggagtgcagtggcacaatcgcagctcactgcgtcctccacctcccaggctcaagcaatcctcccacatcagccttccgagtagctgggactataggtgtatgccaccacgcccagctaatttttgttctttttttttttggtatagacagggttttgccatgttgcccaggctggtcttgaactcttgggctcaagtaatctgctcacctcagcctgccagtttatcctttctggcatttgttggtcttgcacatattgattaatatttttgatcagatttgggatttgggagccattattcattcacatattttttctgccccttttctctcctctcattatgtttgttatatttactaagagtaattctttt

SEQ ID NO: 137896 - DNA, 1073 bp, Homo sapiens
gactttaagcacttcctatattccatgttttacacttgagggtacagttaagaaaagttaacttactgagaagtttctttgatcctgaaactatattcacctgatacaggaaaccagtcttcttcaaaggtgatgagaatgccttgacaagatgatagggaccagcactgtacatttgttcccaagggaatactgcaacatgcaggcacagcccttggtcacctaatacatgtatttgtgaaattccatgggttcccttaagttgggagctaaaagggttagctttgggttagctgtggttttcactagtttctgcttgacaggatcagaagactgccgagacagatactgctatgctgaatttttcatgttcatctcagggactcactgcatactattttttaactacatgtgctattcagagttaggagatcttggatgggactccaaaataaatgatttaagaaattccataccttacattaggaccagagcttgtagtaaaggatgttgtgatatggttttgacccagaaggatgcttttgggtatcatcctcaagaatgtctgcaaaaggttttcagtgaagacaacaaagaatacctgtgctttcactgggaggaggaatgagcctgatggtagtagtgccttttgcttgtggtacatgtagccaaaagagctctgtgatgccaacaaacattgagaaaggtaatctttggtcactgccagctggattggccagtgcaccttgtattcagtactctatattgaagtatctgtcctttgactgtatgcggtgcttattgtacttagtttttagggccctgaaagctttctttgcacttactggttcaaatcccaacatcaactacatgttaaaagcagtcaggaaaagaatgatttggcttattttaagctttaagcataacatactgacagagcttatgaatatatatacaataaaatttatataataatataaatatataactagcttacacatcttaaaatttagatccagcacacaaaataacattttaaagctaaatactttggattttatgcatgagggaac

SEQ ID NO: 137897 - DNA, 3604 bp, Homo sapiens
ttatttattttttaactaatagagacagggtcacgctgtgttgcccaggttattattgaactcctggcctcaagtgatcttcctgccttaacctcccaaagtgctaagattacaggcatgagccaccatgcctggccagtttttgcttatttatagcttctgactcctgtgcctattcctcacaagttgatcttatttaaatctttcatgcttcttacgtagctgtggtatgttcttttaccatgtatccattcacttcagctgagtttctgttcttctgtttttcccaattgcaaatttaatctaattttctcacgtcatccttgtttggggagggctttcatgttacaagtcataggctgttgatcagcgtgtagacatatgcctttgagtctgagctttactttcccttggtctgatcaactttggatttggaggaggggtagttggtcataagaatgctttcttagcaggcttgtttgcctggctaaggaagtttttctttagaaagattttgggtgtgggtaacactatgacacattcactctatctggtttagctctttaaagctgcttgattgcagcatctaccaagtctcttaaagactcaccttcccctgggtaaaagttctaaaagttccatgatatcacaagctggtttgcacaacatcatcaaaacaaagaggattctcttcaggttcgtagccagcttcctaaactgcattcctcttagggggctgttctgcttcttactattggttaggcacttgtgattgctagaaacagattctctgttgagctcacataatgacaggttatttgcaggccacctgtggggaaataatggtgacttggatcacatgcagtttcacatacaggtgatcttttgtgtctgtgtgtttcacatctgtggattcagccatctgtggatcaaaaatatttggctaaaaaatatggatggttgtgtctgtactgaacatatacagactttttttagttgttattccccaaacaatagagtataaccactatttacatagcatttatatcgtattaggtattataagtaatctagagatgatttaaagtatatgagaggatgtgtataggctgtatgcatttactagaatattttatataaaagatttgaatatctgcgggggattctggaaccagttcctctgtggataccaagggacacctgtttagggggaccttaatgtgattatgcctgttagggatgggaactggattcagagaagctctagaaaactcagcagccagagcttgtacatctttccattagcattgcgccatttatttaactgagctactttgtctctctgcgtatctttttttttttctttgagatggagttttgctcttgttgcccaggctggagtgcaatggcacaatctcgcctcaccacaacctctgcctcctgggttcaagcgattctcctgcttcagcctctcaagcagctgggattacgggcacccgccaccacgcctggctaattttgtatttttagtagagacggggtttctccctgtcttgaactcctgacctcaggtgatccgcctgcctcagcctcccaaagtactgggattataggtgtgagccactgtacccggcctctctgcttatctttggtgtcttataatttctgctttttaaatattggctcgcccatccactttgttttttctccatctctctttttttttttttttgagacggagtctcgctctgttacccaggctagagtgcagtggtaagatctcagctcactgcaacctctgcctcctgggttcaagtgattctcctgcctcaacctcgaatacctgggattacaggcaccagccaccatgcctggctaatttttgtatttttagtagagatggggtttcaccaaattggccagcctggtctcgaactcctgacatcaggtcatcctcccgcctcggcctcccaaagtgctgagattacaagcatgagccattgcgcccagccctccatctcatatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgaaaagacaaatttactaggcctgttgtatcccagtttagttaagatatttatatacccacagcaacagtttgtggatcttcacttttgttttctgccattaatatgatgattaccctgttttgctgcttttactttgcttgtttcttatagcttagcttataaagtatccattaacaactgactgttggacttctctctctttgtttcaaggactgcaattgcaaatgcctgtaggatccagatgccataaatgtataagatggttctggtgttttcttcttttcttgaaacactgtcttgtgtgtgtgaggggggtgatcttttgttcagtcatttttgatagagacattagaagagcgatttctttaaaatataaacaagggtgcaaatgggatggtaaagggcaactgacgctactaggaggatagtagggagtgtttgacattgtgtgtaattgggacatacatatttcctccaaaagggaagactttagtacttctgctgattgttgcctagtggaaatgtctgcctaagattaccagttgtctacaaaaagcctgattggcttcaggtttttttttttttaatttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttggaaaaaaatacaacaatgcaaaataatacaaattttaaaaaatacaatatatttatgtggtgtttacattgtattcgttattataagtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacat

SEQ ID NO: 137898 - DNA, 1027 bp, Homo sapiens
tcgtcatagtgggctttctcatagttatgcctctgattttcccttgtaacttcttagaataccttcttcacctctcatctttgctactgattacctgtttccatatttcacaattttaagtttccgagagcacaggcgatagctaaattaagatgctttgcatgttaccactattatgtactttgcttggctgtctaccctgttgcttcaatataaccaattccaaatagctgcattccttttgagggtctcttccttgcaatccagagttcattgcaagaaatggggtgatttggatcattttaaggaagtttatggaattcaactctagtgtggtatcattaatgtaattaagctcttctctccttatgtgtatcatgttggtcctactacagtttggtttcctcatactctgtcttcctctaacctcctggttactgaatacttagattttttttctcattcataacttgagcttttgcaactactataggtgtgaccttccttctacattatctttctctctacagactatcgactttagctcttgctactctccatgttgccaagttgtcattaaactgagaatctgattccctgtgggttaagtttcctgagaccgcagggatagtagttgctatttggcaggtctaggacatttccccctactgattactatgtgcaaatgtatctctttccctatttatgatgcaaaattgctttagcctaacacaatccagctactataagtgtatccagaatcaagctctaaaactagaatgcaacccagtcatgtagcatccagaagtacctgaaccatctttggaacttgacagtttcacagttaactctgcaaccttactctccttatatcctgatgctattttatatgcctgttaggttgtatcagatctacattctgatctatagtttggagattataattttctaagcaaccctttgtgaggtcacagatactttttgtttgttactggttataggcattattggttctcatcactcagta

SEQ ID NO: 137899 - DNA, 1021 bp, Homo sapiens
gtatacatacacaaagactttcaaacaaagatgtatacaataaaacaaccattcagagttatttgattcacagtgtgtataatataataaaaataatacagctgtatttgagtcagcactgaaaagtctcttgtgatctgtgtcttacgtgcatgaattgcagaatattcatacgaataccatgaatattcttcacgggccatgttattaccatcccttagaggaatctcttccttgtcgtgggtctttctttgtatggcttagaagtgatgttgtctttatattgtgttatttgttcttaactttacattatcagctctggtgtgcttacctttttcaccaacgtgtcttctaccctacttacctcataagtgaatctaatacagaggttattttggatataatcattatcttaacaggcaagatagtgggctgtgctatttcaaaccctaaatttggctttcaggattatgaagtattaattcttccactgatatctcaaaaggtgatctggacaaaggaacaggtatctcaggtaagcaattgttgaatatgaaagtaaatattcttctttgatcgtttgttgtatttgttatgtttaatagctttcctaataatgaaccaactttgcatttctggaagaagattcgtacttttttgagacggagtcttctttttttttttttgagatgtagtctcgctctgtcgcccaggctggagtgtagtggtgcaatctcaggtcactgcagcctctgcctcctgggttcaagcaattctccagcctcagcctcccgagtggctgggattacaggtgtgcatcgccatgcccagctaattttttgtattttttttagtagagacggggtttcaccatgctggccaggctagtctcgaactcctgacctcgtgatctgcccacctcagcctcccaaagtgttgggattacaggcatgagccaccacgcccggccagattcatagttttcaagaattttgaattatatttgctaaatttgatattt

SEQ ID NO: 137900 - DNA, 1064 bp, Homo sapiens
aaaaaaaagtcttaaaatattcaggctgtactacagaataaagagtctaacctcttttttccctattctcccatttttatagatgggggaattagaaattgcccaagattatatgagaccacagtagatggcacaaattgcccaagattatagctagttggcatagaaaatggatttgagtccaagccagtactgtgtcttctactcagtgcttcatctaggttctatcaaatccaaggaagccatgtgagacaaaaatgtttttatttcacagtaaaagatttttttttctttttcttttttttaaattagagatgggggtcttaaactatgttgcccaggctgttcttgaacacctgggctcaagtgatccacacaccttggactcatttcacactaaaagattctgtaatagctcctgagattttactcctctgatgttggaaatttccatagtgtgaagttttgttatgcataaaatcacctggggtgcttgttaaacatgcagattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggtaagttgtcagtggctttggtggggttccccagttggtggtagaaaagagaagggaaactggtcgtgatctggccctttctagctttctagcttattaagtacttactaagtgccagagactgttgcagatattaacaaagtcttaccatggaactttcattcttgtgaagttagacaaagggataagtaaccagtaaatgtataatgtatcataagtgttatatcaattgttttttcccattataatgtaaaaaattgcacttaaaaatggttaggttaaactaagcaacatcttgtgtttttctccctttttcccattctcccttttaatacctgccacagttgctcaatgcaatggaggctgaccaagctgagtgtcaggaaggtcatagatgatgc

SEQ ID NO: 137901 - DNA, 1065 bp, Homo sapiens
aagaattcatgtttgtgtatgtacatggaagttgttggatgaacataccccaagtgttaaacttttctgggattctggctgatttttttttttgagacggagtcttgctctgtcgccaggctggagtgcagtggcgtgatctcggctcactgcaacctccgactccctggttcaagcaattctcttgcttcagcctcccgagtgggattacaggcatgcgccaccacgcccagctaatttttgtatttttattagagacggggtttcaccatgttggccaggatggtctcgatctcctgaccttgtgatccgcccgcttcggcctcccaaagtgctgggattacaggcctgagccaccgcgcctggactctggctgatttttacattctttgcctaatatagttctggaattttgtttttttttttgcagtgttcatctatgactatcaaagttagaggcacattgaaactatttccattttgaaattgttgacctgaacagaagtggaataaatgggggtggtgaggggttctggaaactggagaaatttagtttggaaaagaactgggtggggtggggggaagggaatggtggaaataagatcactgccttcagaggaaggcactaactaccacctacccctctattcctggctccttagtgcaagcattttctggatcagtgtttacacttctcatttatttcacagttaggccctctacacattccttttctgcccttgtccctctgggctttaaagctacaataattgctagtggcagcagctgcttatgaatatgcaagtcttgctctagtaaatggtggccttagttgctccaataaagagatggctcaaacctatcaaggctcctgcttcccctctcctctcagctaggcagcaccaatcttccctatctatggtgggagaactttctgcctgggtctcatggtcactagtagattagaggacagatactttcttgctggtggtaggtaaaacagttaaaaatgagtcctgggtaactgctccttgggacttccaggggtttgagttgagggttgcc

SEQ ID NO: 137902 - DNA, 1046 bp, Homo sapiens
ggggaggcgctcagcattcgggtaattaaggttgcaaaatggcgaggggggaggtaagctgtctttgcttggccatcttgggctagcaggccttgcagagaactacctttttagctgagtgaagggatcaacctgagttggagttctcctatgctgtggccagatccactagaaattaacccagaatcttagcctctcagtggcctatcggtaagtgggtacaaaaatgaggaggcgatgatgactctgcaaaaggttgcggcagctggcggtgcgtaggaaatgcgtaaaaagggagcacttggagacaggccacatttgggcagtacgcattcggagggctctctggctttccgatcttgggtcgctgtacttggctctgaatacagtcaccccatcagagtagcaaaacactgtggttgtagtgtgagaatccaatgttaatgttggccgaaagctcttgattttcttccctgagaacataggcgtgaggatttggatgtgtttccaaatgcttgttactctttgccgtaaacctggaatttggacctatggctgcctgggactcatactgtcgtggagaaagattgaaaagtagttaatggcagtggtggtatgaaggtaacctgggctttcaccctttcctttattttttcttctgtagaactttcagcacggttttgtcaagggagaagattagagtttctattttaaaggcagatgtactgtcatgactctctgaagacttgctgttaatcgctaaaactagtaagttagcacttagatacagacatagttagaaggagcacaggattaaaaactgaaaaaaacatcttttcccagtaatcctagctattatttcatggtggtccttttccttctctgggcctatttctctctctcgctcatttatttatttacttttagacagagtcttgctccgtcgcccaggctggagtgcggtggcgcgatctcaattcactacaacctccgcctcccgggttcaagcgattctgatatctcagcctcccaagtagtagctgggg

SEQ ID NO: 137903 - DNA, 1071 bp, Homo sapiens
acaaaactcctcagacgccgggttaaagaaggaaggagctttattcggccgggagcgtcagcagactcacggctcaaaaactgagctccctgagtgagcaattcctgtcccttttaagggcttataactctaagaggggtccgcatgagagggttgtgatcgattgagcaagcagggcatacgggactgggggctgcatgcaccggtaatcagaatggaacagaacaggacagggattttcacaatgcttttccatacaatgtctggaatctatagataacataaccagttaggtcagaggtcgatgtttaactaccaggcctggaatgcagcaccaggctgtctgactactgatttcacttctgtcttttctttaactcctactttttctttgaggcagaaattgggcataagacaatatgaggggtggtctcctcccttattaggaattgaacatgagatggcacacatatttatgctgtatcaaggtcacaattatcttactgtataaaactgaaaacatcactatctggacagttggacatgtttatggggaaaattatgtttatctttatttctatgctctgtactagtaggttggttcattaataaatatgtgaaaacttttgtttaaaaaaattatttagaatatgcttcattcattcttcttgtccataagactgggaataataaggagtattgtaaattactggcaatttttttttttacagagctcttaagttaccatagaaatgaaatagcttttcccaacagattccagatatttagaattccaaaggttgagatgataaaattcagtaaggccttgatcactgtttgagcatctgctttagctgataggagcacttccagtaattcagacatcatatacaattattctaatcaatatctcttaccttctgaggacggaaactctataaaatccgtttgctaccagattccaggtaataatgccttcagtaggcttccttagcttccttatgtgccccctgtaaacaatttttctgacaagcaacatacctttgtattatatcctgaattatttgatct

SEQ ID NO: 137904 - DNA, 1097 bp, Homo sapiens
ttcaattgttttttatcatttcatccagaacaatgtccaagaaagaccgatatcctacctgcttcagtctatttccaagccatttctttccactggctgacatgccactgttcagttattactcttgcctgcacccaagaggttgagtcagagccaagccacaagtcagtgccagcaaagtagctgcatttatttccattctgcagcagtagataatttatagatgtatttagggtgagttgacaggatttgtggaaaaaggggaaagatggggagttccagagtgaacatagataccaaatcagtagaggaatgaaacacacttatcagacaatctttagaatctcacccagggagctcaaagaggatagagcaaggaacactaggtcagttctccagaaatcaagttgctatgataggcaaaatgctttatggtgcataggtttgcttctgaggcagggagggcagaaatacaacagagctaaagagtaagcaaccagacaagataggcagttcaagggagggaaatgacagaggaggaggtagggggaactagatgataatatgagagaaaagtgaggtagaaagctctagagatcaaccagagcattctaaaagcaccaagttaaaaaccagttgactcatttggaggtcagccaaaccaggtagggtagctgcatattgtattgatgtagctaggagagtgaagaggcagtgacttgagctttcctgatcatttctgcaagaccacactcctgctcccacacccttatcaacattatttggatgagctcatttctcattgccactgtagccccttcaacctacatcaaatgatcctgcattctatcagaggtctccacttcccttcatccctgtttccaggcagaatattgagagaaacatcttaattgttcttgcaactaatatccattattacttgatgcaagttttcatgtaattgaaatccatatttaatttggtcattttatccagggcaaaatgttctatatattccatgagaaatacaagaaagagcagagggtctattcaggctaaattgtttgcaagaaacccatttaagctaactaaaataa

SEQ ID NO: 137905 - DNA, 1687 bp, Homo sapiens
ttgatcttttgtatttttttgatttggtttcatttatttctgctctgatgtttattatttcttttcttctactaactgtgggtttggtttgctcttgcttttctagttctttaaaacgtaccattaaatttttgtttgaaattttctttttttggtgtaggcacttatagctataaacttccctcttagtactgtttttgtcgtgtcccatatgttttggtatgtcgtgtttccattatggtttatttcaagaattttttttcaatttctttcttaatttcttcattgatccactggtcatttaggagaatatagtttaatttccatgtgtttgcatagttttcaaaattcctcttgctattgatttttatttcattgtggtcagagaagatatttgatataatttcatttttttgagtctgatcttatttacttgttactcaaaaaattttatttctgactggattcaggcttagaagtagaaggtcgcagagaagaaagtctgtgtctctttgcaatttgttcttggcgcttctctttagcctccttcattctcttggccaaaagtttagcatattctgcagtctcttccttatttttcttagtaccctgcttcttcagagcaatacgccactgtttgtgttgcaggacacatggattaacaagatgctgaatcttgggtgctttggtcctaggtttcttacattctttgtttaagggctttcttacaacatacttggcaaacatcatctttagagagattgagaaatttgtggattctgctagctcttttgggccccaggcgacgaggcaccatagtatcagtcagtccaggaatatccaatatccttctctccttttttttttttttttttttttttacaataaccaagatgagaacgctcagactggcatccatgaaatgattttctctttctctctccagttatccttggtctgtaacaggaatgcccctcactcagtagcaggtggacacgaccacgggtaaagacaccctgcttcatgggggaaccttgttagtcgtttccaccactgatttggaccacataaccctttcattcttcacccagagcataagcagcaacttctgtagccatacacttctcataaaaagtatgaagtttacgttcatcatccacttcaatgagtttctggcagcaagtggctgggaaggagatgttcagcttcatcttgaagcagctgaacacctctgaggcaccacagaaaatagctataatttcaattttttaaaaatattttaagactgtttcatggcctaacatacagtctatccttgagaatgatccatgtggtgaggagaagaatgtgtattctgcagccattggatggaatgtcctgtaaatatctattaggtccctttggtctatagtacagattaaatccaatatttccttgttgattttctgtctgggagatctgtccaatgctgaaaggggggtgctgaagtctccaactattattgtattgggacttatctctctctttagctctaataatatctgctttatatatctgggtgctgcagtattgggtgcataggtgtatatatatttaaaattgttatattctcttgctgagttgaccacttatagtgacgttgtttgtctcttcataaagtttttgtcttgaaatctattgtgtctga

SEQ ID NO: 137906 - DNA, 1095 bp, Homo sapiens
accacatggatcattctcaaggatagactgtatgttaggccatgaaacagtcttaaaatatttttaaaaaattgaaattatagctattttctgtggtgcctcagaggtgttcagctgcttcaagatgaagctgaacatctccttcccagccacttgctgccagaaactcattgaagtggatgatgaacgtaaacttcatactttttatgagaagtgtatggctacagaagttgctgcttatgctctgggtgaagaatgaaagggttatgtggtccaaatcagtggtggaaacgactaacaaggttcccccatgaagcagggtgtctttacccgtggtcgtgtccacctgctactgagtgaggggcattcctgttacagaccaaggataactggagagagaaagagaaaatcatttcatggatgccagtctgagcgttctcatcttggttattgtaaaaaaaaaaaaaaaaaaaaaaaaggagagaaggatattggatattcctggactgactgatactatggtgcctcgtcgcctggggcccaaaagagctagcagaatccacaaatttctcaatctctctaaagatgatgtttgccaagtatgttgtaagaaagcccttaaacaaagaatgtaagaaacctaggaccaaagcacccaagattcagcatcttgttaatccatgtgtcctgcaacacaaacagtggcgtattgctctgaagaagcagggtactaagaaaaataaggaagagactgcagaatatgctaaacttttggccaagagaatgaaggaggctaaagagaagcgccaagaacaaattgcaaagagacacagactttcttctctgcgaccttctacttctaagcctgaatccagtcagaaataaaattttttgagtaacaagtaaataagatcagactcaaaaaaatgaaattatatcaaatatcttctctgaccacaatgaaataaaaatcaatagcaagaggaattttgaaaactatgcaaacacatggaaattaaactatattctcctaaatgaccagtggatcaatgaagaaattaagaaagaaattgaaaaaaaattcttgaaataaac

SEQ ID NO: 137907 - DNA, 1010 bp, Homo sapiens
tgggatgttgtataggcccaactcctgccagagtcacaggcccactcctacacatcctacagaggcctcccttccccctttccccttcctttcctctcttactttccactttctgggtgaagggtgactttcgatggagcactcaagagtgtggaagccatcacctctggattttcgcataaagatagctgctatgacaccctttttgtcacttctacacctctttccacagccctagtaacccagctcagaaggtagtattgtagaaagtcttactcaataatattcaacaaatgtcgtcattacttgtattcctttcttttcaaatcctgactatcattgtcccccatctcctgggccagctgaacttccagagatttcatactggtttttggtagcttccgtgtttctggttcattctattttgagcccctgacatctattttcttgccaaaactgctgcacaattggttgtagaggggtcagagaagggagaagacagacactcaagtcctaacgagagtcaaaagtgcctttacaggaagattgctccagcccaggaggttgaggctacagtgagccatgatcaccactgcacctgtctcaaaaacaaaaagaaagaaaaagaaaaaaataggccaggcccagtggctcaagcctgtaatcccagcattttgggaggctgaggcaggaggatcacttgagcacaggagtttgaggccagcctgggcaacatagggataccccgtctctacaaaaaaaatttttaaaaactaggctggcatagtggcacatgcctgtggtcacaggtacttggaaggctgagatactaggatctcttgagccaaggcggttgacgttgcaatgagccatgatcacaccactgcactccagcctgggtgacaagtgagaccctgtctcaaaaaaaaaaaaaaagtgccttcagggagggtggaggtgggggagtgaagctcccagtttagttgctcttctgcttttacatggctgaa

SEQ ID NO: 137908 - DNA, 1092 bp, Homo sapiens
catggaaagctcaggtgaaaccggtcagaccagatgttgagaaactgcagcttttaggaagagaagacagatagatccacaggcagcaagaagagagaatagggaggtaaaaaacctattgttccagctcctaatcacaggacccccaccctcatcacacacctatgggctccagcatatcacttgctcaagaaggcaatggctcatctgtgtcccatgagtggatctgcttattatctccacgtaagaccacccaacctaaaggctactttccaggccatagctcaacagagactaacatttgccttgaggctctctttttaaaaatggaatctgtttttagcactaaaggaaaagatagccttggagtgggaagtcacaaagaagaccccaaagttcaactctcctttgcctcacttttccacatgctttgtagtatagggtaaggcacaggatcttataacagacagaccagtgttagagtcctggatttgccatttacctgatctgcaatcttgaccaagtctgagcttcactccctatctgtaaaaaaggggcagtgggagcatcataatccctacctcacagtcttacgataaggttcaaatgaaaagatggatgtgaaagccctttgaaaacagctttgcattatcatcatgattaccacatacataagtttatctatagacttgcacatgtgcttatgcacgtatagccagattgatataccacccatgatgcacacgtgtataagcaaccacttatatgtacaaaactacacatacatctgatcttaagcctgaactcatgacacagacaattaaaagtgcatacacatacacatttatccacatggatatactttctccttctctcacacacgtacacccacacaagcaaatgtatatgtatctctgtaagtgtgtgcatgcatatgtgtgtacatctatagcctcatagctgtacaggtgagcataccatacccttcagtttctgcctagataatccagttttccgggggtctgacaaaggccctgtttgtaaattcctccacttgatactgataatgtcccttttgcccttgctgaggct

SEQ ID NO: 137909 - DNA, 1079 bp, Homo sapiens
ccatacttgaatcaaggtagaccatgacagatctaccttgattataaaccactatatctctccttatgaagcattatactcaattgttagctcttactgttagagctaacaattgagtataatgcttcataaggagagacatagtgattctagcacctaacacaatgcactatacatagtcagtgcttgataactttgtattgaaatgaaatgagggccaggagtgggagaacatgagcttgttttggggaaggcattgtgggcaagaggggccaagtggttcatgcctctcactccaggcatgctgggcaaagccaggatccactgctgacttctcaggccttatttgcaaggctgctttaaaggtgctttgtgtttgggtttgttttctgacatcattgttcttagcaaccaaggtcagatttttagcttttcctttgactgctaaccatgcccctctgcctaagaaatcccacaggaagcctccaagcttcactttgcctctagacacctggcaaatgactctcccacttccttgccctgtccacagactctgatgctagttgcgggtgccaagatttttttgccccctcctcttcccctgggaccaatcagatttctgagctccagggtagagccacactctcactgatcctctgtccaagtctagaattcccaaagcatggtctgcctcatctgtgctccaggtgcaactgggcaggataaatttctcacacattggtcctgtccttccctgggaagcctggctttcccactcccacttacctaagtcaattctctgctttaaggctgggcgcggttgctcacatgtgtaatcctaggactttgggaagctgagggttgagcccagtagtttgagaccagcctgggcaacatggcgaaaccccatctctgcaaaaaaatacaaaaattagccaggtgtggtggcacacgcctgtagttccacctacttaggaggctgaggtggaaagatctcttgagctgggagattgaggctgcagtgagccatgatcataccactgcactctagcctgggtgacagagtaagaccctgtttc

SEQ ID NO: 137910 - DNA, 1054 bp, Homo sapiens
ctgagccatgactccgatcttgatcaaccatgttatttagcagggtgtggtggtcctcagcatatatatatatatatctcacaagtgttcactgcctcctatcaaggctagaaggtgagcggtatcctgggaagaagaggctgaggccagtgcccccccaggggctggagttgagttgaagtcatggctgtcagcagatagaaatgtcaactagtggtggcctccagtggaaacatcttgcagggagagactgtaccccagccagtccctggagttttggaagacaaaacactcactgaaggacagagtttgagttccccctccccactggggctctgccacttagaactgtgtgactgtgggcaagtggcttagatacattctgttttctcagtcatcaagcaggtatacttaatacctatcagtgcagttgtgtgtagtaatgcaggttaagtatataaaggggaggtgctcaagaaatgttagtttcccaacctttccctctcctatcctagtcccaatagtcacacccactgttggaagaaaacaattgcatctgacactctctccaactcctacctcacctccttggccattctccagactcgggtgattaagaagatagaaaagataaggaatgtctggagcacataagggtccatacattcagggtaactgcaagggcttctggagtataatgactttggtcaacaactagcatgggtggcatgagcatgttagcccataacagaacaagtactgggatgtcagggccgtggaaggaaagagccaagactcaaggtggtctgacttcaatgcatcaagcagaggcttgctggtccctgtcctcttctgttctgctttttaaagactaaaggtccctgtgggtatggagaaagcagctgcatctgagaaaataagtaatacagtagaagctaaagatggagttctgtggcacccatgagaatgttcctggaagacttccaactacggggagcataattgaccaagggtcttggctgctgcactctgaaatcgtcccagcatttgtgct

SEQ ID NO: 137911 - DNA, 1120 bp, Homo sapiens
gaataatttaagacttgtataaggagttttcttgagggggactgagaggcaaaagcccttgtaaatattttatatttactaaaacaaaccactaaatataataccaaataaagatggtattaatttccttttaaacccactggcctagacaaaggctagagtcttcacccagctaggggagactggaagtccataagtgggcaagagacacaaccctaaaatattcagtttcagacctaggctaggtgcagtggctcatgcctgtaatcccagcactttgggaggaggctgagcggggaggatcacttgaggccaggaatttgagaccagtgtgggcaacatagcaagatctcatctctacaaaacaacaacaacaaaaaacttgaggccaggagtttgagaccagcctgggcaacatagcaagatcccatctcaataacagcaacaacaacaacaacaacaacaaacagacctattgctcctccatggagccagggaacatggcaacacagaggactcccatctccagtactaggccagcctatggccagcaaacagctgttgtttcaggaaaggggttcagagagaaattgcatggtgtgaaaaactgttaatgaaacaggatatgagatccatctcatgtcttccttccagtactccccaaggaaatggccatacttgtatttcactcttattttattttacatttccttaataaaattttaaaaggtttcatgaggctatatggaaacgaaggatgactcttcaggccatgaggagagtgtggcatgagattttgccgcagtatggaaaggagaagcctggaatggggaaccaagcacaaaaactttgtcctgggagttcctgcaggtgtccttgagaatgaactatggcagagaaaggcaggggcagaacccttcagagagcattgactcatcagctgctacaacctgatgagccgatcaggttcttgctgctcttgcccacccttcagactctttccctgagcctcaaagccagcttgaacaatatttcactcttctaggctgcctggggagttgggagtggtgctcagcccattttgtgggggttggagactgtttgtgcaccagggcagtcc

SEQ ID NO: 137912 - DNA, 1070 bp, Homo sapiens
gtgtagggtctgctgcaaacccatgcttcttccagggctctcagtctctgttactttcctcaccaaaaagttgcccttttgtgtatggtaaaaacaacgttgtccttccctgaattaatttaccaaccttggtctagaagcccatgtctttgtcacaatactcaatatttagtgatgtggccctagagaggttttagactttcagtcaaggttctgatatttttggtctgattctgccaacccagatcattttatggccacagaaccaaatggagctagatgctttcctggcacaattggtgagttttgttcaattcaacaaacctttcttgagcaccatgtcaccatatgcccagatagctctctgccagagagagaggtataaagccctttaagggcccgcccctcccctccatcttcctgcctttttctaccttgctgcacttcttctgcccatacaggctcagctccatctagagaaagctaagctggaaagtggtaaggggccttagatataatcttttcagaacccctcatgatatagacagagaaagcaagacccagaagagtaagaaacttgacctaggctacacagcagattagcagtagggtttggagttggggtctaaggctaagggggggcttctaaaacaaagagaatatcccaggttagtatgtgcattggggtggatgtgggaacatgtgaaaagccggtcaagaccaataacctagactttgtggccacatctaggattggtttgaaggttaccttgtaggcccctagcactcccgcccaaagtatgtctcagaaacagaaatggcacctctgggtaattcttttggagcttgaaggctgtgcacatttaattttccaaaaataaaatcctagtataggcaaagccttgtaggaacaaagccctgagggaggcagctcagaaaagacaattaagaaaaccccagagagcctttgtaactacatagtacaaaaaattctaccagtttaaaaaagatattcttgcctccttccatatattccacagactgattgttgtcaggcatgctccatgaca

SEQ ID NO: 137913 - DNA, 1018 bp, Homo sapiens
gagccctggctgaggaggaagtccattcagatggttggcgagccttagaattttatttttggtttacagatgggagcaggttatggcttaaataccagagactcttgctattcttaccaagatgtattagagtttcttgaataaatgttccttcatttgctgtagaaaattaggacaatttccagagactttgaataattgatatttaaatgaatttcgccagttgcagtttttccttttgggtccacagggctcctcatactcccattctggaactggaagcctctctgttaagtctgtaaacacttcctttcccccaacacagatttcttcaatctgtctaacccaaaaacactgccctgggacaggatgtccctatgtaagcaggacagtgggagaagcctggaatttaaggcccaaattgggtctagacattcttgataaatgtgcctatcctagcgacttgccatttaaaaaggctaaacacaaggtgggacataggggatcagaagggagcaagtgaggccactcccccatactccctaccctgagtcttgcccctaagagttgaatattggtggtgggagggggactcatagaagagagaggctatagctctctatagcaaagcagattagagtagctccattggccccctagggaaggagcctcagggaggctgacttgggtttcacaagaaaaagtacattctaagggtaaagtacataaagagctgcttcaggaagaagtgagctccctgtcatcaccgaggttatctaagtaaaaggtagagggccacatgtccaggaccctctatcattcatttagagttagaatcccaggacccttgggagaccattgaccctaaaattcattgatcctctgtgtttggagaaggaactctgcccagttttgtctagccaagtcaggtgattcctaggatttttgacataataagagttcagaaacaccccagggaccacgggcctttcctggggttttgcaaaggagcagaatt

SEQ ID NO: 137914 - DNA, 1113 bp, Homo sapiens
ggcaggccaggggaggtcttgggaaatgcaacatttgggcagataaacaaaaatgcctgtcctcacttaggtccataggcacaggtccggggtgaagccccagccaggggccaggaccttaaccccttgtatcatttaaagggaccatgctctttccttcctagcacttccatatcactggctgtgcccatttctgggggagtcagttctggttgcttggagatggtagccttagggagcaattggtctcccctcttcaggacagacaaagaagtttgaggatgtgcatgaccttccagcactttttgtcatctcagcgagaattgggcagcttctggggcttggaggagagctgaggctacccttctttatactagaggttctcaaagttttttgtttttggttctcaaagttttggggtcggtaccccaaagctcatggttaaagcttcagtggtttttccaagcagaaattgcatattgaaactgggtgccctttcttttgctggctgtggggatgtgaagtgtgggctgtagggcctcagataatagcacaatttctatcaattgttctgtaaaatcttttcttctcttccctgctgatgcagagggccaaaatgtttccttcttcaaaccagtgcccgtgatttagctttcattgacattgataatgaacataaaggtccctgagcaaggctgccccttttgtacatccttgctgctcttctcctatgtatgggggtgggggggatgacactggaaggaagggggaacgaatgagaaaatgtcctgtggattctatatttaatgtgttcagtgacatgcagagacgtttaagtgggatttttgtaaccacctttgcaaaatgatgacagtaagggaaatctgacatagttgagtccatcttgcttctaacctccaagcagtccttggtcactcctgggtataggccaagctaactttgggaggaatttagtttatggtttaaccttaaaggaaggatgataatagtctttcccaaaactaagcagcctttgtaaaactaatgaaaggccacaagattaggattatgaggagcctgaattctgctaagatgtagggtatagttagacaa

SEQ ID NO: 137915 - DNA, 1076 bp, Homo sapiens
gaactgacaggatagtaactaggccctttctagggccccttcctacccacagagctaagaaccagtgggttttcctttggggagttgataagagctggactgggaccagcggagggggctcaggactttggccttgaatgaaatcattggaggccaaccatgccccagctgcctgtttgtaacggaaaatcatgagtgggaactattgtcttctttggagcccctcaggacaacctcatcctcctggcccggggatgaccctgccttaaggtggcaagttactgttggctccaagtgacagccaggaatgcctggcaaaaagatgatgaaagggtgggtgacaggaacacaatagacaaaggctcagagaggagaaaaagagacacaaagaggcagagtgaggagagaggctgagctcctaatgaggtgagctgtgctaactgaacacagcctggcagtgccctctgcccctagccaggggcactgggaatgttcttcagtaagactgttgccagagcctgggcataaggaggcatcagtcacctacttcagagggatcaaagtggttcagagtctacctttcatggcacctttaatgccctctaagcaaagtggcctaggatgcccagcatgggagacacattgggtggtaaaggctgggatggcttccccttcccaaaagaaattttccaaccctatgtgcaactgctgcctgtacctttttgggatccaggctaggaattgattttttttttcttaaatagtctctttcctggcctggcccaggtagaaatatagacctgtcatgaaaactgagagatggggctcaccatatcaataactactgcccctcctcccgccatggcagctcgtgtcatcagtcctcctctacctgctgagatgaaaggagtttcttcacattttgccatgtgtatacaagaatggggtgctgggagggccttgaggttaatgccttggactgtaagatttgtaaaaatcagtgactggaacatggaacactgtggtgtttaaggtttcttccctatatgatattctactcttccagtctaggatta

SEQ ID NO: 137916 - DNA, 1167 bp, Homo sapiens
ttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaatttggtttgggtatgtatgttgcctacaaggaagaaatagtcttaacctgattaatagcagaaagtttgacttcagagctgaagtctcctttcaaatcaaatttctgccaggttctatgctctctgtgagagcagacattagaaaaagagctatataggggtttggagttggttgactatttgagattggatttttaaacaagctctgaagtggaaaagtggttacttcacaaaatgagaatgtggttacttgctgagttggaatggaggccccaccaaggccacagccttgctacaaatgtgccatattgaaaactggcattaataataatccaattcagctctccttccctc

SEQ ID NO: 137917 - DNA, 1016 bp, Homo sapiens
ttcttttcccctcccctggcattccagtgtattaacatttggcaggtgggctcggcgcggtctctgcggtgacgagagttggggaaagatgctcccaagtgtagtccccggtctccgcgggggggccacaggctctggcaggagtgagggaacgaggaggcccacgacaggtgctgtctgtccgctgctctgacaggcccgggcgggaatgcggcccggcccagtactgctctccccacccactcagctggacgcggactctgacacttgttagtgtgagcaatcgactaattttatccggctggggctcagcaggaaaccaatgccgaggcgcgggtagttcttccgggcgactctcgcccccgggaggatagtcgtggggagaggaagaggggttgggggtgggattcctgccgcctccatttcactgggggcgtggtggctcctgatctgcctcagagaggaccgaattttggcgctaaggtcggtactctctgggtactggcgcccagagaagaaaagggtatcttggaagttaggtagtacaaactctttgtgttcttctggtttttttctacttatgttcctttcattcctgaagttcccggattctagcagagtgtctgacacgcagcaggtctctagaaaagactgcttaaatgacttgaaaaccaggcatagaactttgcgcttggtgaccgctagagagagctgaaaggcaggaatcaaaggggctttgaagcatagcctcctgaacccctgcaggatttgggtatctaatccctttccttgtgcctctgcagtctctgctgcatttcagcttattagaatttctgaacttgcttcaagggctcttattctacccgtcacccacactatctaggcgccagctatgagacactagggatttgtaatccttgtcagctggcctgcactgctactgtggagaagtggcagggagctgctggccgccttttcagacgtgaaaagaccctagaggagagcatatgctcgta

SEQ ID NO: 137918 - DNA, 9247 bp, Homo sapiens
atgcaaggttcagactacttatttgatctgatctttaacttcatgtccattgaaaaccttggtaacattaagaaatattcaaatgcttttaaacctataaatcttgtttgtatttttcttatggctacaataaatagtcctgtattttaaaacaacctcaaatgttatcaaaggcacagtatgtagactaataaaaatttgacagaaatgtagcttgaactaaatgtgactgttcgttaaacactgtttccttacctagtttgattacattagtattttggcagaggactgaaaaaacgtcttctgaccatcccacagtggtatgcttggctctgtatatgataaaatactgaaaatagacttcctccagattccctttaaaaatcaaataattctctaaatttctctagtgtagcttgctcttttcaaatggaattagaattttcttaccttataaatttatgcagtatagtttgtaaaaatctgtaattatgaaatgtgttccgaatttttaagttatttaatgcagagtttcagagcacttatatgattgtcctcattttagtagttcctttttctccctctccccctcctttgttttgaacaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaatggaggaaagagactataaaaccacttttagcatatgaattgcagttggtacacatgtgtgtgttaataggaaagtctcgaatttgtgttgtttttgagatttgtcatttaaggtaccagtgcacacttgatcatatttcattactatctctaacacagtcctaacatctcaaatttaaagaccagttgaagattaagggatttttatcctttgttgaaagtcatgttgggttatttgaaattcaaattttaattgtgctgcccatatatgaaaatgagactgctgactcgctatctatggacatgcactttatgttggtttcttagtagtaagagtaacttcatgataaccccagtcttcttgcctaatttcttttttgagactagctggggttaggattagaatgactatggagcagatatttgttcttctgggaaaagctttaacaggccaaaatagggattgaacttgtccttggcctttatcaaagcaagctagctacccagacgtagtcaaatactctacaaaataaacaagtctgctttaggaattgtctgggtaccttcactgttaccaacttagctgtaaagattatttcaaagctcactcttccatgatttcttctggctttcaatcctatctaagtatcaaggaaattaacttgtaaatatggtagttgtttactaaggatatgtactgctcttgcaaggaaataatgtccaaacaaagcttcacttattttttttaatataagcagatttcactgtttatggcgcttatgtaatacattttatctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtgcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaatcctggaaagatttatgtgaatgacattttaagtaggcgcatctttgctgtttcttgtattctcgccattgctctgaccactcccttgcttgccctgtatatatacaaaaacttgtaggtgtgcacgtgtgcttgtacttctgtcttccatttctatcttaatctcttaaacatattgcttaagccactaagatgtccttgtttcaagtaaatcgtcacattgtgacacctggtgtattgtattatagtttcatttcctctggtgcctgcagagctatctgtcattggcatcataactcggtttctcaggatagttttgatgtagtcagctcttcaactcatgaccttcccaaggttttaagtttagtgtcattcatgattttattatttgaaactcaataccaccatcaaaaagttagtgctctagacaatgaagccaaagcacaggcatcttaggtcagtgaaaaggatccagacataaattagccaggtgtggtggtacacagctgtggtcccagctacttgggaggctgaggtggtagaatcacttgagcccgggaggtcaaggctgcagtgagccatgatcatgctgatgcactccagcctgggttacagagcaaaaccttgtctcaaaaaaacccccagatacctagaagaaaggattcgataaatctgggtggattataaactgaactcttaatggtcattttaaaaaataagaaagcaagggtccagtttctttgaggtctttgaatttagacaagatttaactataaggccttgcatggattactaactataatt

SEQ ID NO: 137919 - DNA, 1079 bp, Homo sapiens
tgggattacaggcacctgccaccatgtctggctaatttttgtatttttagtagagatggggtttcatcatgttggccaggctggtctcgaactcctgacctccggtgatccacccgcctcggcctcccaaagtgctgggagtacaggcgtgagccaaagttagatgttatatgcaaaagaactttgtaaattgcttttaatatgtttccaaagaagtgaatttttcccaggacctacctactccttggtttttctttttggtttgaaaaagttttctcttttaaaaatatgattttttttctaatcatcttgtgtcagattactgtgagtcactgataaagtatttgattgtcatacccctaatgtcatctttgccctgtggtgttaaatttcaggtgaaagtactgaggaagagttgctgagacgactacagcaaattaaagaaggcccaccaccgcaaaactcagatgaaaatagaggtatgttttggttttggtggggaggtggatagacgatgggatgataggaactttgtaatagtaaatgtcagccaaagattatccagatttggcacaaattaatttggtgctaagtaactgctcataaaaagaaaactgacattttcttgatacttagaatgtcagcattttttttctacctcacctttgagatgtttatgttaattggaacacagtgagaaatggcccatttaaatgtgattttgtttgtttgtttgtttttcacctccattgaaatttattcctacttaattccttctttataaacatgtgacttcttcaccagcaaaaagaaatgtctaaacccagtggttcctaatgagatataattttgccccatgtgggacattagcaacgtctggagacatttgtgtagagggcaggaatgctgccaaacatcctgacatgccataatgcacaacacagcccccatgacacagaattaactggcttaaaatgtcagtagtaccactgttgagaaatcctgctctaacctcaggtctggtgtttccctcccagtgtcaagtagggattttgattgtgcaacctgagaggctacga

SEQ ID NO: 137920 - DNA, 2138 bp, Homo sapiens
agactacacataggggctacttctgcagttcaaactccttgaataatcaacacttggctctttgaataaacaataacttaagtagtatcagttacatttgtcaacaaatcaagagccaaagagaaaaccactccatcatttaccttatttttcagttgattagtgacattgcttttcaatattcccagctttttggaccactatacttaccaaaagtccaatattatgtttattttctctggacacatttcttcagcttctgcactcaaacataatttcactaactcaccatcaataaacagctttcctcgtttagccaataaatgagcccctgggaaatttactttgattgaagcctcatttttatttttgtgaagaaatattttgtgatgagatttcactttaaattttctaactttttgaactgtagttttcctgtgaattgggaatattgtcactagtgtttaatagtgtcagtatatattgtatttagtatatagtattttttgcataatcatgcattctttgccatctaatctgatttttgaaaaacccatcctctgctgcacctttaagcgtgacattcagagtccacttttctctttgtttgagatgatgagtgtatactcagttttttttaatgtccagtgtgaaggcacttgaaatgctgtcattatagctacatcactgcaacttaagagtgcacagagcagcagtccaaagcaatgggagtgccacatacagtctgtcacaactgctcaactctgccattatagcacagaagcagccatagataacatgtaaatgaatgtgtatggctgcgttccaataaaactttatgaacactaaaatgtgaatttcattgcattttcatatgtcacaagatagtctctaaaaaccattcttaggttgcaaggagaataaaaatatgcagcacgaggctgggtgcggtggctcatgcctgtaatcccagcactttgggaggctgaggagggcaggtcacttgagctcaggaggttgagaccagattgggccaacatggtgaaaccctgtctctactaaaaatacaaaaattagctgggcgtggtggcaggtgcctgtcgtcccagctacttcgggaggctgaggcagagaatcacttgaacccaggaggtggaggttgcagtgagctgagatcgcaccactacactctagcctggttgagagagcgagactccatctcaaaaaacaaaaaataccacagtatggctggatttggcccaagggctttagttcgccaaccctgtctggttcaagggctgtagtttgccaacccttgacctactcttaatataacagtgcttttcaggagtttttgttaggaaatttcatttgaggtctgaaaatccatctctagacctacattctggattttcacataattaaaacttgtatagaatacatagtgacctttattttcaagattagtctcttttctcttttcaggtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtatgcttacatatatttaaggatttataagtgtaagttgctggtttaaaaaaaaatgcttgaacctgttttaaaaatccatttctttagcccttatgaaatattatttaacataggggatatggaatgacatttattgctgtatttattacctgattatatttactgatgtttggaattacactatatcagagagatttttaacttatgaattatgaatttttagcgaactgaattgaaaagaatggagctaaatcttttttttcttagttagctttatctaacttactagataagaatccgagtgtggaatagctaatgggaacttagtttttaggaaagacttattctgttatctctgattttctgaatatgtcccagttgtaatcctccagagctagccttgggtaacatagcaattagaagtttgtgcttaattatcttttaccccactaagtccc

SEQ ID NO: 137921 - DNA, 3356 bp, Homo sapiens
cttgtcacccaggctggggtgcagtggcacgatctcggctcactgcaacccccatctcccaggttcaagtgattctcctgcctcagcctccctcccaagtagctgggattacacgcatgggccaccacgccaagctctttttttttttttttttttttaagtagagatggggtttcaccatgttgaccaggctggtctcaaactcctgaccttaggtgatccacctgcctccgcctcccagagtgctgggattacaggtgtgagccactgcacccagcccccgatactattgttaaagagtttgtgccactgctgtaaatgtctttggcatgtgagttttctcttttatttggttcatgtccttcaaatgtcagaacttaaccagatatctttgccttctttggaagatttatatttttcaagccttttaaccctgcagttgttttcagaacaatttacctatcctacacaagtgaattttgtcttaactttcatgcattagcgttcaaactactaaccgctttattaagaacattagttaaatgttcttagcaaatttgagaaattatggctgactttttttttcctttgtgcttttctatatttttaaaaatcggctgcctttaccacttctaataccaagttgtattacttgagattcatgtgggaaaacttggcttccttttcagggtttttttttgttttgttttgttttgtatttttttagtgcctgttttttgtgcgtgttttatttaagctggtgatttctagtgtcaaagtttcaagtattataaagtaaccatttgtcagaagtttatgtagtataatcttattacagttaagcaatctcagttatgagattaagaaactccaaaaatattatgatctcccccccaccaccacatttcttgacatactcatcttaattaaacaagataggatagttctaaaaataatgatctaaggaaaacagtggagatctaggtatgcctctgtctagactaaaatttatttaggcttagcaagcaggcaaggtttgacaagacaggcttctttgtgtttttatatctggagtaagacttgacttatttttctctctaggattgaattgtgaacattccggcacttcaggtgttgtgtgtgggtgtatgtgggattaagtcatagtaccaatatagactaccctttttccataaattttttcgtattgtcctagtctgttcaggctgctgtaatagaatatcataaactgggtggcttataaacaacaaaaacatatctttcacagttctggagactagaaaatccaagatcagggtgccagcaggtttgatatatgttgagggcccaattcctcatagacagctgtcttctcactttaacctcacatggcaaaaggacaaaggaactctctggggactattttataaaagcgttaatctcattcatgagggccccacccttatgaccaaaggccctacctcctaatatattcaccttgggatttaggatttcaacatgtgaatttgagggggacaaacatttggtcagtagcacatatgttcatggaatttagttgtgttcgtggggaacataaggggaatctggggttgtaaggtaaagaattagaggatgaacatttttgtttgtagtctccctgtattttagattgttgactaccattgttttttattagtgtgcagttcattgatgagtatgtgtggaatgtctgccaatattctggtttccttaaactcgtacaaatagtgaatgacaagaatttttggctaagtttatgtattacctagaacaggagttggcatcctttttctttaaaaggccagatagtataatattttaggctttgcagatcaaaaagcaaaattgagcatattgtcacacaaaagagagaaaccaaattctcacagtttttcctgataaaactcaaaatgtaataacaataattgagtacagtgtttcgtgagataggtttactaatgagaagaatgatactcttttgagggtaacattttgcttaattgggattcatagctagtattccttattagtcatttgcaaatgtccatttattgctgacttaaatatttaatctttgaaaatatcttttcatacatataggtattgctatcttaagcaatccacaagtgtatgattttagtgaagcatatatagaattttgttagatttttatctttttttttttttttttgaaacagagtctcactgtgtcgcacaggcaggagtgcagtggcgcgatctctgctcactgcaagctccgcctcccaggttcatgccattctcctgcctcagcctcccgagtagctgggactacaggcgcccgccaccacacccagctaatttttttgtgttttgagtacaggtggggtttcactgtgttagccaggatggtctctatctcctgacctcgtgatccgcccacctcagcctcccaaagtgctgggattacaggcgtgagccaccgcgcctggcaattttttatcttttaatttaatttaattttttatgaagatggggtctcactatgttgcccaagctcgtcttgaacttctgggctcaagtgatcctcccacctcggcctcccaaagtgctgagattacaggtgtgagccaccacaccccagccagatgactttaatatttaccttttggcatattaccactgcagagatgtcacttctagttgagggttagatggaagctcctcagttgcacagttaaatggattttgaaataaggaaatttattttgtgcttacattggggtctgcaaaacagttctggaactgtagtttgagctcagaaaatgtatgtgctacaaatttgtgtgggaatggagctctcattactttgtcaggacatgaagtatataaaacagcttgacattacatgtgataccaatgttgttgctgaaatggctttaccacagtataagtttcatatataagtattttttgctttgttgttttaggatggattcattaagaaacattatcaagtctgcaggaaacactaattttccaagctatttattgtttgataatagtaattgagagcggttctcacagaaaataaatccatctttgccttgagcacaacaaatcacaataaaactttaccaatattagcccatcaaatgttgtgttgtagagcaagacaaaatttctgacaaaaattcatggaacttgagcttaaaccagagttcataagagagaagtttatcattagtgctactggttcagtaatatgatagattgaaattttcttcagatcacttgatgatgagtaataaaatatataaccataaacgttaaatacc

SEQ ID NO: 137922 - DNA, 1386 bp, Homo sapiens
ttctcaaagtgaataaaatctgttttaaataaatctcagggttggtgttcttgctggcctttcctccccagaattaaacttactggatacagtcccattcattgaccagatgagtagctctttgaaacgattgggcaaaatttctcatttggtttcttgtttccaggaatggatttggatatattggcacacagtactctaaaagaaataaggttaataaaatatgctgtttatctaaggagcaactgtatttttaaaaattactaaaagttgacttatttaaaaataagtccatctaggtttgtgctgcttacaaaaggtgttttgtcattttggaatttttcatacagggagtgaacatggtataaaaagctcatagattgaatagtttagtcatacctattgggattgaaggaaggaatgtgttttaaagtatagagtcttgggatatgttgggaggcagttgtcttagtgaaaagttgactggatttggaatgcagagacctggatttaattactggccctttcccacttactagtcacatggtttttggtaaatcactttctttctctgtgcttctgtttgtcacctgtagaggtggtgattcctaattcatgggattattgtgaagattaaatgaaatacaggtgtaagggctatgtaaatacagggtgatgagtattgcttatagccagagagagacctaagtgacttcaaaacagttatatttcattgtttaaattactgtatgtttcacgggtaatcttttcatagaaaaacagctgatgctaatcatatgctgaagtcagaatttctgacttatctgagataactaaagaaatggatttatgaccttctcttttacgatgatgttgaaagatcccagcggtgtataaggattctctttttcctcttgctacttaagctagaaatgtaccacaatgttactcactgcaaagtagaatctggagacctgttttgttaatgttattcttcactaatattttcacacccaaaatggagatagagctgtatttgatcatttggagtatggttttctggtatttttggcatgcctaaactttaaaatgtttgtttgcacttagtaaacaatagtggcagattatatctacctggggcagaacttgtggtttttagatttattccatttctttcttttatgccgcttagatagtgaaggtctgcttaaaataagaccaggctcattgggtgtgtgagagtaaaattagtttacaaggcatttgagagcattgccttgatttccattttctttgcaaatgtaattatgtctagtccaggggacctctgcaggtattgtagccatagcttactctttgaattcccttataagggagggagtgcct

SEQ ID NO: 137923 - DNA, 5524 bp, Homo sapiens
ggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtaagtgaagacttgggaatcctgtgagaaatgatgtagagcgagaggaagacagcggagccgcggctgccgcgttctctcaaaatggcccgagtgacgcgtcgtggcagaggctcagcgccgcctccggaccccaggcccgttgctgcggggggctccgtggcgtagtcgccgctgccattttagttgagtggtatagtcgacaggctctttgaaggggaaggaggtgggtagtacttcctctcggtggccgcgcgagctgcagcccaggccctccggagccttaggaaatcgggggaggcagtttttgagttttggcctcaggcgtcagaatcttagaacgtctcaggctttttcttctctgttctctggaggcttccctgacctccccgcgttttccatggcgggcttgggtttgggaaaagggaagtaaaaaatcaggctgccccaagtgagatgctggcaactcttgggcctttagatttccaaaacctcattttgagcccttctgcagggtattaccaattaggcgccccctggggccgcgatgacatcttccctgaggatctgaggcaaatgtggtttactcccttgctcgaataaccctggcatatcctttgccaggtatcactggaaggatccccccgcaaaagagagggaaaagccgttaggtgtttgttgtgttctcctggataagggatggaattgggccaaattttcaagttaatttgtgtttaatccaccaacaactcaatccctcccccattaaaaaaaaaaaaaaaagcctaggggggtctctgcttctgcagacggtacctgccacgcatgccatagcttagtaactagtattaaccggttgggcttctgcttcctgaatactcggtccctttttcccttatgctgattaatttcaagatggaggagacagccacgttccttccctagacagtttcaccatacttattccacaggttagtctgggaatctgaggcctagcagtcttgttattgaggtcattttttttttcattttggggcaagaggaagcagttgtatcagattgtcatcttccatttgcaagaccccacaatgattttttgccagaagtaaggagcccgcatttcctgaatcagaattaaccgcagtgttttggactgattgaaagggggaagaaataataaacctactgctactaatcatttctttcattcttcgtgattatagacagagtaactacttatcaccccattaagtacattgtatcttccctggaggactggcacaattataacccctccccccccatgacttttctaaactgtagaaatatagcttaggtagctagaaagaccaatccactttttaaaacttgattttaggacacactccacttactgaaaaatgttacaaagatttttttagtccatgatgttctgatgaattttaatactttagttcctaccttaggctagtgtaatgtgccagataagtccttgaaagtgactatcagaatctgaaaataattactggtctgataaggaaaggcttattttaagcaagcttataataaaacgtaaattgtctctcagtcttagaagacatcttttatctaactcctggtcccctctgaccttcttgctctccccaaatgccctaatactaatattgaattaggttgggttatggtgtgtctgtatttttttttttaggttgtgtctaattcaaagaaaatgtgtatctttttaaagaggaagaataatggattctttttttttctagagcagagtgaagaaaactaaaatccagtttattgtatttcaatactatgtcataacagtcaggtaatttattttttgttgcgtctcctgatgatttatgtgtagaatgcatgtttacaaatatttattgttctattttgcaggccctgtaattggatgggctcattgatagatgttagatggtgttgggtattcttcatgataagaatgggtacttttcactgggaattaaaagggtaatgtttctggatacctggaactcaccagtgctttatctgtgaatttgactctttaaaataatgtctgaagtttaccaatacctgtatagaacaacaacaacaaaaaatttgttgtcttatatcattgttggaatggcatgagtataagtaaaataacatttaaatgttcattggataactaaatgaaatatcagaatagcttacgagagtataattttacgttactttgtgtgtggtggttgatttttttcctttaagattcaaaaattcataattgatacatgatacttttaattgatattgactcctttcattattattatcatcatcattagggtaaccacataatttattgcctaaccaagacacttttaagaacaaaaggaacattaataattcctggacagcaggtgcaaaccttgattgtccccgacaaactgggatggatacttagcctaaattcataaccaacttctgctgaaggcctgtggtgctaggccatgtgctttatatgcattattttataattctcacaacagagcctcatgagaatgttaacttttatagaggaaaccaaaaacccaaagaggttaagtataatttgtcctcagttaaatagctttaagtggtggagccctcattttatcccaggcctgtctgacgttatacttctgggtttgattgctgtctaattagataggaaatgcaatgaaaatgaaaggttgtagtaaaaagtctgtaggttatgttgcatcagaaacttttgttaatacttaaaggttatccagcaatccccccttttcgtctgttacgttcctgtttcagctattatgcatgtttacacatatttattgttctatttcacaggccctgtaattggatgggctcattgatagatgttaaatggatagctccttgtatatcatttgataaacttaatttaaaatcagaaatgattttaagaaatagcttaataattaaatgatctggaaatactaggctggttggatatctttgaggttagtgaacatgtagtgagccttaatatagtagtaggtcaaatgaggcatctgcatttatggaattatattatatgtacattaatttttccatggccatggtggattagaaatagagcaaatcaccagccagcctcctgttctcttcatttaccatagagtggatgacaaattagagaataaaaagtcttctgtcaaacccaaaccaatgagggcctagaattttgtgccactgcctagaactggacaggtttttctttaacacaaagatttctaaaacctatggcccattgatttcagaaagtatctagtttacataataaattgaagttctgatgtccaatataagaaagtaataacacttctgtatctatttttctttcatttttttttctcagcctcaaacatgaaagtttcccagataatccagcaattcatttctctttttatcaattgaggtatttttatttatttattttttatttttttatttttttgagacggagtctcactctgtcgcccaggctggaatgcagtggtgcactctcggctcactgcaacctccacctcctggtttcaagcaattctcttacctcagcctcccaagtagctgggagtacaggcgctctccaccacgcctggctaatttttgtatttttagtaaagatggggtttcaccatattggccaggctggtctcgaactcctgaccttgtgatctgcccaccttggcctcccaaagtgctgggattacagacgtgagccaccgcgactggccaattgaggtattttttaaatatacctcaattgggggaatatatttatgaacttgtggtttttctcctgacatatatagttggtatttttgctctagattttcttatattttaatgttccaacacaagggttttttttttttggttttttttgtttgtttgtttgtttgtttgtttgttttttggttaggagggcaggacgagttttgctctgtcgcccaggctggagtgcggtggcacgatcttggctcactgcaacctccgcctcctgggttcaagcggttctcctgcctcagcctcccgagtagctgggattacaggcacgtgccaccacgcctggctaacttttgtatttttactagagatggagtttcaccatgttggccaagctggtcttgaacccctgacctcaggtgatccgcccgccttggcctcccaaagtacagggattacaggcctgagccaccgcgcctggccaccaatccaagagtttaatttcattagtcacagtagcacctacatatctgtgagacaaataatctgtaggcagagagcacttggtgcattacatagattggtggatttcttgcaataattttgcaactacaggttggtttgcttttataacatttgagagtctaatggcgtttccatgatgatgaacatgttacttcctgggagaaaggaagtatttgtgtttgatgtttaaaatttttttctggaatgacaaaaggtcccttctgatctccccttgactataggaggaaaagtgttaactacaacttttgttttttattgaccaatgatccctttagtgctgattataactaaggagaccatatgaattatctaaactgggacacttttgagagtgaaagggagagccatattactgattacttcagtacaagtgtaaacccttactcttctggacaaaccaaagatatattgtcaccctcttcatgttatttttatgtaggtatactagttcaggaaggacaattgtcagcatggttggtcttaaatacaaaattacttcctcaaataactgattggtatagataatactttcttttttagttaagtgattttaattttttttttttttttttttttttttttttgaaacggagtctcgctctgtcgcccaggctggagtgcagtggcgcgatctcggctcactgcaagctctgcctcccgggttcacgccattctcctgcttcagcctcccgagtagctgggactacaggcgcccaccactacgcctggctaatttttttctatttttagtagagacggggtttcactgtgttagccaggatggtcttgatctcttgaccttgtgatctgcccgtctcggcctcccaaagtgctgggattacaggcgtgagccaccgcacccggctaagtgattttaattttaaaaattggcttcaatctttaaaaacctgatttttgatggaaaaatcttaggtccttaaaatagtgccttagttactgatgaacaccaacattgtcagttatcagtgatttt

SEQ ID NO: 137924 - DNA, 1054 bp, Homo sapiens
actcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaat

SEQ ID NO: 137925 - DNA, 3292 bp, Homo sapiens
ggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgt

SEQ ID NO: 137926 - DNA, 1640 bp, Homo sapiens
cactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgaggtaatactgcaccagtatggctgagatgatgcacccttagctctcctactacctactaagcccgcagtccctcattttttccctcttgaaagcaaaaatttgcatgaaagaaactgtcccattcccttctttttcaaagtaaaaagaaaattttaaagtgcatgaaaatccctatacctttaagccacccaaaagattgggcaattttgttgtggcttggctagggataagctctaacaaagctatttcttcttctgctattcatcactagttactacatattaagaaaatagaattaaaatatgctcttgaatgatttttggaagtgaaaggctttgcagtaagacagattttgaaaaatagaatttaaaagtcatgtagacaaaaagccaagatcatttaaacaaaagagcattagctggaaaacaaaatctgaacatgtggcaaataggag

SEQ ID NO: 137927 - DNA, 1004 bp, Homo sapiens
caaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagt

SEQ ID NO: 137928 - DNA, 1040 bp, Homo sapiens
ctttttttcttgctaaaaagtataattgtagcttgatttcccccaccccccagttatttccccaagaaataggggcctttttaaaaatttgaataagaagctggataagcatttgaaagacatgaggacagtggatacctgaagaggtaagaagttgaggactttaaagtaaaagccttaatgactaatatattttttcagaaggtcctgcttccaccatttctgcaaggaacagatgactctaaagatatcatatcaaggtctgctttctgcttgttgcataactggatggagtaataaccaagattgaaactgtcattggttaaaggagactaaatggagcaggtcatggaaattgaggtgtttctttctttccccaaggaggggctggagagaaaaagtagcagagacttttgtcatcagctttcaggggcagaaaacattggttcctctctcctctgacctgcctctccacctaaaaacctgaatggattctggattccacttcaggctgttttgagttttgatagaataagtttgttaagatgttggggaaaagcaaaatatggtcttccaggatagccctggtggggagaggtagaaaatggtgggataaaaagtaggattatactagggccatgtgaaaccatccacactgtagtggaggagcttgactgcatggcagaaggcaaggtttttcaatttatcctaaaccatatcccacaatgttccacggctctgtctccattcagcaaatatttgcagacactatataggctgtaggaactttatcattcccattgcttttggcaccacaaaatgtcttagagatcaacagaaaagatgaaggaaggacctgattgccccattcaggtagttctccccattcttgtagttctgcttagttgctttgagcactggtttctgtgtccccctccttgaattaccacaggatcctggggattccacttcacaatttaagagtatcctatcaggaattctttaaatggtactctgagtggtgaagagggagaagaaga

SEQ ID NO: 137929 - DNA, 1489 bp, Homo sapiens
tattggatataggtatatcttttttgtgtgtagcatgttattttatatatctgccttatgttttgtttttgttttatttaaatgttggacttaatgcagagtaatgtggaggctctaaattgtttgcttccttttgtttaattaaggctatgccatctacttattccacctccttaaagaatctcaattaactaaaatatttcttttccaagtgttttctcacctctcttctttaacctcacatcatccctaggaattttgtgcctgttattatgatttctgtttgacagagaagaaactaaggtataaagaaagtaaacagctaggccagtattctctgggataaaaagcagtcaatgttactcttagacttgtgctttttttcactacagcaggttttccaagttcagcaccaatcacattaggagaaaaggctgcagttgcactgatcttggaatcaaaagatttggtctgtgcccctggttctgcctctcttatgaccttggacaagcatttaaggtctctgagatcctacaaaattgggtaaatgccagcttttcttgaaactgtctctcaaacttttctactcttcagatatctttctctaatatcatcttctttcctctgattttcttgtacttagcttttctttcttctatttttcttcctgagactttctctgtctgttgcagccctgactatcttttctggcctgcccctcctcctattggtatcatgttatcctatgtaatatttatctgatcagtttcttgcattatctttggatgaagagaaagtaagcctcatttggcatctttataaaggatacagtaccttaattgattacttgtcagaaagaatataaaatattaaacacgatgaagattaaagattccaaataagttggtaaaaatctattttactttaaggaactaacaaagaagtttatttaaataaatttttttaatgaagaggccatcaagctagggaaactatgtgttaatttggtgttgggagagatatatgtatatgtgtgtatagtttcaattaagtttggatagtgtttgtatatgatatataaattgtgtgtaccaaatgagttattgctagtgattaacagtgaataaaataacttctaagatgtgttagttactatttactgaggctgaatgctagaaatactgatagcatgaaactctatttcctaattattctcagagtccaattctgccttctgtctaatcttcactaaatcacagcagcatatttttcagcaaattgtgaaactcaggtaacctggttagaggagaaaagattaattgaatcacataaatattctctttgaagctagacttttcttcctcttatgttcagatgggaataaatcatatccacccaccccaccttacttagagagttttctccatgcctggaaggcaagggcaaagaacacagagatttcctgtctacagtcacttaggagtttagc

SEQ ID NO: 137930 - DNA, 1162 bp, Homo sapiens
tagcaaagcagctcactgacagcagtgactggaatattgccaagctagtcccagagctcagcctactttgtttagaaattaagcaaatggaaagtttcctgaggttctcttacaatgcaagaatgtatggggtttcatttgtgaaccaacagggagttaaaaagcaggaagtcaattatatattaagtctcacattgttctgtaattgttttcatcaattatatttttagttgtatatttttggccaattcgcttgtgtcaattacatatacttccttatattgttgtcaaattgtttcatgtgcatcagtcatagcattcctatgtaaactggaaattccccagggatagggaccatgattctcttttgtttcccccaggaaatagcaagagacctggcacatgttttgagtgttgaactagaataaggtatttcagaatacttaagtctaggtctgtagtactattgtggatcccctaaaacactttagattccacaatagcactgtgaatgttgacttaaagcagtagcatgactttatattccttatagagttgtttccagggacactgttaatgtatacagtcattcaggatacaaactagaaagtagaaacatacacttatctttaaaatgagaggatctaactgattcatggcctgttcttggcttttccacttgtgtctaccaattaaactctttggactcaagagtttttctacctgcaaaatgggatagtaattcctacctcggcaacttgttgtgatgattaaatacaatatcatgtcaatatcctggcagtaccagttccttggagtgagaacaggtaacctgttgtccattttcttggaatgtgctacagggatgacaatgaatctttctgcaaatctattcagaaattctggttctgaggagtagtatccatgactgatatgataatactaaagttctgtcaagctctaaaattctgtgattataattttcattatcccttttcatgtgtattatatattgccatttagagtaaacaaaatgttttcccaaccccttatctcatttgaccctcacaactgaaagaaatgcatgaaaagctttagcttattcattgagtccttaatatatactacatgagtacatgtgttcaataaaaccactgagtat

SEQ ID NO: 137931 - DNA, 1551 bp, Homo sapiens
cagacctactgacactttgattttacagtctggcctctctaactatgagagaataaattactgttgttttatgccactgactttgttgtaatttattacagcagccatagaaaactaatacaattattaatgtgttttaaatccatggtgttttgagaatacaattcaaatacaggttcaatattaaccatctggcttccttgccagctagcttgaaattcatttgtttatcatggaggagtaggtcatttgtgttaattactagctcaactagtagttttgctaaaagtaattttcattttttaaataaacaaggacacattttttgaccaaggagaaaaatcaagcatagagaataatcataacctttgaatactattcaacaggagggatttttttgtctatgggaatacagaagaaaattggtaaacaagcagtctagaccagacataagctgtatgtcagtgattataaggcaagtaaataattgtgccttagaattgatcaattcagttagaagaagggggaggagtcagccaagcctctaactagatggtctgaccatttacttgactaaagagtcatttgatgagatgagtgagatgaatatttatgctcagcaagtgtctgacatagtatgtactcaaaatttaatttaatattattattattactatcattaattaactcacagccttgagttgacatggatactttttaaaaataatgaagaaggtgttaaagactgcatgctgccacttgaaaatgtccttgccaacaggcccttataattgaggtagagagacaacatatgtgggctgcgattacaaagtaataaatatttgctttaaaaaatcagtagttacatatgaaaattcatgctgtccctttccaaattggctactttaggaaacttacattattttcacaaaaccgatgttacttaaaagtgtttttgagatcatctccagaccctccagtatgttgcttagaacctactttgaaatgacagtcctttttcctttgagggtggagcagctatgtcatttggaactaagttcacattttctaggttaacgtctttaaagtagaatgcttatatgtatgcatgtacttgagtttgtcttcttttggggagaaactatatttattttgttatcaaggaatccacttctatgactcgtgaagcccaggctgagttaacagtgatgagttctagagggacctacttcccagtctgaattttctggtttcaattcatcttctctcttaacctgaactgaaaacccagacttatgaagcctcaatccttgccctcttattcctggaaaattgcaaagccaaatatgtaggaggctttttcagaagagaaaatgactttgtgttttcagaaaacaaacccttcactttgctttatgaggcagatagcagccccaaaccatgtacaggttgggtcctgcacagatcttaattggtttcttttctaaagatgaatttatgtcattacttaatgggcacaccccatatatcatcagcattaaaatgggacat

SEQ ID NO: 137932 - DNA, 1050 bp, Homo sapiens
ctgcgtcgctcacgctgggagctgtagaccggagctgttcctattcggccatcttggctccaccccaccacattttctttatccagtctatcattgatggatatttgggttggttccaagtctttgctattgtgaataggaattttcttagcaaatatgaaaatttgctgagagaggaagtgtgcaaaatggtttggcaggaaatcacacatggaagggcccaactgggtcactttgtgtttgaacactacatgggagactatgttgaaatcctagatttcaacaatcctagattagaccatcacggaaaagactcactactaggtggcagaggccctttcctgttgctcagagggacttctagtcgtgaaaacccataacctcctccttgactgtgtactagaagcactgctaagtgaaactggttaattctgcatctatttttgtaatgtggcaatttacatgctgattggagccaggctgtgggaatgtttttggtctaaggccatggttctcatggtggagaattttgccatttaggacatttggcaatgcctggagacatttttagtcacaagtgggttggggggtgctactggcttctaatgggtagaggacacagatgcttccaaacctcctaaaattcacagggcagctcttccctacaccacacatacaaaaagaagtacctgacccaagatgtcaacagtacctggattgagaaacactggtttaagtgaagaagcctgggtctcagagaattatttgtatttagtctctgcctttttcccctgtatttgctctgtgtgtgtgtgtgtgtgtgtgtgtgtgtgtgcatgtgtatgtgtgtgtgtgtgttggaatttatccatttaagtaaatgtaggaaagccctcagagtaccttaagagtatcactgtgctatgaagaaatgattgtgctttacagtgaacttgaggggagattcacttggggtaccaggctccccaaaggttgtaggtacagcacacatgcctgaaaacacagaaacatctgccaacactcacctgg

SEQ ID NO: 137933 - DNA, 1276 bp, Homo sapiens
ctctgtttaagtaataagtatatatgtatctataactcagtagtgaaacctttcagactgacaggagggcaaagcctctaagactatattagggtttacgggtataaaaatacgtgcctctcctgctttaccaggctgtggggagaatgaggaaaataatatctgtaaagtgacctgagcacccagaaagaaaaatttagatgttttattagacctacgcaagatctttggttagttccccagagccctgtaaagtcttggaagccctgtaacaaatttctcttttcccttgtcaggtttttgttttcccctggtgcccaggttaaagagaaattgatttctttccatcttgtgtttagcttttgtccctctgcattgaggctttgaattgagaatatttctttgggtctgtagggctgtccaatgatagttaggcttaaacattaaacaaccttacagaactaattaggctttattgcctgtggccaagtcaacgaattttgcttcatagaatttctgagagaaaaaaaaatacatatttaggacttggtaaaacttttcttaaaatgtctccttgtaaatgccagcgttgctgaccctgtgcaaatattttgtaatagcccggcttgagaacatcccccacatttctctgttgtattctttatgacttccctccaggttgagctgtgaaagggtgaggggaaaggagccatgtcggagaagtagaagagactgaatcaaatgtttagagaacatagcttgattaattcaaaactgaagccctggcctctctagtctcatgttccacagcaataatttctccttggccagaagcctaagcatctgtgtccaaatctcatactctttcctaaatggattcatcaagtcagaccttgagttgcttggttttttctgaaccaccccctaatttaagttaaacttaaaaatgggagccattaaatagcaaaacaaacaaatacaacaataataacaggacattatgtcctggccctcagaggtcaatttaatgtgattagcagcataaaacttcacaacgcctttcactggaagattaccagaagcaacatcattcagtatgttgccatgcactgccattctttcactttggcattatttattgattgtagcagaaacacaatatttgtacctcttaagcattttagtttcctttaggcttttctctagtaaatgtggaactgcatcattttgttaaactgttctgaagtctaaaaaaaaaaaaaaaccctcctgaata

SEQ ID NO: 137934 - DNA, 1046 bp, Homo sapiens
caggctggtcttgaactcctggactcaagtgatctgcctgccttagcctcccaaagttctgggatttcaagcgtgagccaccatagcctggctctttttatctcagttagtctggctaatggtttgtctattttgcttaatttttcaaaaagtcaactgttttggaaactggaactttttaattctccctcacccacaaaaggattattcattgtaaattgaattaacatactcttccctagatggggtatctcagttaatgggaaagccaggtcatgactccaggtccaaatggccctgtctgatcctggtggttgggcagctttgcataaatttaggatgctataatttctgcaaagcgtcttatgattccaatattagactttcagaaaaaccttccacatcatccatgcactgtgtgtacatgtgtgctgaatatttttaaaatcttacaacttgcctaaatagagtttttccatctccatcttgggtgcttaatcacctcatcttcttttatctcttctttctctcctatgtttgttgaggaaacaagattaaatataacaatttttacattgcacacaaaataaaatggcttgtttagctgtgactttaaggccacgcatgagacagtctgtacaggacttacctccctcatcagaggaaccctttgagtctttaaaaaaggtgaggatgaaaaacaagaaaactcttttagattttcagctctccatttgctctgcagcatgagaactaagaagcaggtggcaaagatagacagtaaactagaaggaaacaaaacaaggtcattttcctccttgtaccttagcttcttgaatgataatttaagataccttcaattttctgttatctgaagtagtctgctttatggattacttagactcttgtttcttcatcctttaactgtttggtgtcacttcttccaaagctttttaaaatatattttctgattctactggaagagcagtcatagggtgtaggcatgtaggaggaaacaaaattatagggacagaaatcagtctatt

SEQ ID NO: 137935 - DNA, 1031 bp, Homo sapiens
gtttccctgtgattctgaggcaacatttctatcactgctatcattggtgatgtggaattgcaaatatcattagccgtgatgtattgactactgccttaaaattatagtatggagttgttgattctgactaatgaattgaatgtactctgcaaaaagccagctgtccatctttgagtgagttgatttttaacccctatttggtagctttagcagttttctactatggttgctgtaacaaatttccaaaatcttagtggtttaaaacaacaaatttatatttctacagttttgaaggtcagagattgtctgaactaggcactgactaggctataatcaaggtgtaggcagggctatatttatttctggggtctctgggtggagactccattttcttgcttttctggcttctaggggctgctggaattttttagctcatggtccccttccatattcaagccagagatgggagattgtttcctcacactgcatcacttaaatcttgcttccatcattacatttccttttctgactctcactcttctacctccctcttctgtttataatgacccctctacttatatttggtctatctggatggataatctgggataatatttccatcccaagatttgttgattttcaaccataattctatctgcaattttaattcctcttgtgccatgtaacctaacatattcacaggttctaggagtaggatgtgaacatctttgaaggcctttattctgcctaccacagtgacttgacttttttgttgttactttttattttggaataattatagaatcactggaagttgcaaggacagagaggccctgtgtatccttctcccaatgccccaatggttacattttgcataatagttctgtgtagttctgtatcactttatcacatgtgtatatttgtgttttttatttatttttagttttgtagaaacatggttttactgtgttgcccaggctgatcttgaactcctggactcaagaaatcctcctgccttggcctcccaaatt

SEQ ID NO: 137936 - DNA, 1032 bp, Homo sapiens
attatggcagaagtggaagcaggcatgtcttacatggccagagcaggaggaagagaccaaaggaggtggtgctacacacttttaaacaaccagagctcatgagaactcactcactatcatgagaacagcaagggggaaatctgccccccatgacccaactacctcccaccaggcctgtcctccaacattggggattacaattcaacatgggatttgggcagggacacaaatccaaaccatatcaagtggtattcagattcatgaataaatgtttattgcttgttgtcttggtagtttagaatactgtagagcatgtgggttaatagaaccctaagactggaggggtccattaatgataattactgattcaattcagcaaacacttattgaacatctactctgtgctaagccctgagatattggggacagataaaagaataaaatgaatttttctgtctcatagggaattagctttgctcctggctgggtctttttaccatctgcatgaatttacccccctattttcctaattcaatgcattcttctattgtttctatgttctaccccttggtaaatgtcttagtctgtttcctgttgcttttaatggaatgcctgaaactgagtaatttataaagaaaaggaatttatttcttaaagttatggaggctgaaaagttcaaggtagaggggctgcatctggtgagggccttcttgctggtgaattctctgtagggtcctgaagcagtaccatggcatcacatggcaagggggctgaatgtgctagctcaggtctctctcttcctcttcttataaagctaccagtcccactcccgtgataacccatttatccattaacctattaatccattaatccatgaatggatcaatccattcaccttttaaaggctccacctctcaatactgccacatcagggattaaatttcaaaatgagttttggaggagacaaatcaaacctcagggagtttcttggcaaataggtatctctagctgggttgagacaagatttccagc

SEQ ID NO: 137937 - DNA, 1560 bp, Homo sapiens
atggaaaagattttgcttagccgcataaacaaacacataatactgaagtaaccatcagcaataattcattttgaggtgtgaatagtgttcaaagtaagttattttgtgatatgggaaacctttagtccaagaaggttaggaatgtttccaaggtgtggataattttcccactaagagatacaaagctatttttttttcgtatgattgtaagtggtccctacgccattgtcgtcattaaccattattttcaactaacaaaatcttaaattacttgaaaagcagttattgtagggtccataactaagtcttaaaggcatttcttttaaccacttcatattaaggtagttctatacagggaaataatagacaaattaagatgaaagaaaagcttcctaggatgattcattcagaggaaatgccaagaaaaagggcatttaattatagggtactaattttacattataatattatgtactcacacaaaaggataaagtgtataaatttctaaatcagtgttgcaacataatgttttttaatatattgagatgaatcaggtacagttttagaatatggaatctgaaaatggagcaagatgatagggttttattttttatgtctctttattttaaagattgaaaattttactttcttcctaagggacttccagtttacaaaaattaagttgaaaccaaggtaatttgggattgtaaaaactgggccagatgccttactgaaggttcttaacatagaaatatcttggtgagcagatgggctcatttggaaatttttaacagctcaagtctgagggtcacttttgaaaatcagaaagagaccttagcatttggacatgaacaagctcaagataagccttatgtttttcctctacagagatttgcaccttttataaaccttaagataaatattgtgtcattcctttggatgttgacaaagtagtttgtgaagatggctgtttttaaaaaagtttttgctttaaaggcaagatatttaaagattgtatgattccttatttctggatctctttgtccatactgccatcttgctcttatccttcctacttgctgaatgtgttgctgagtagcaacttttgccagtgtatattcacaattctcttaccttgtatctttagtactagatagtctgtcctggattaatagttgaaagcatttaaatatgtttgcaattgcagttttcttaaattgtaaacaaatccctttgaatatatagatttttaatgtaaattttatagtaaatgataataccaaatcaaatagattaaaactggtcagttaagacaaaataactcagtcagagaggcccttaacctcactgttattgtttatagcaatctatgtagataaacattactaaataacattatatttgtgacaagaaatgggtatcccattgaagcaactcttctctgcagtgtccagggaaaactgatattttgtcattcacatactgagaataaatacagataattaagagacactccgagggtatgaccttacagccttatgcagaaggtaaaaacttgga

SEQ ID NO: 137938 - DNA, 3115 bp, Homo sapiens
aattaattgtagatgagagtttggaatctataccaccaaatctttgcagtgttaagtttaataaccattgttaacaaaaatagccactggaagaagtaaacttttcattttcattaaatcttttttattttatgaaatcttttttatttcaaagtacacataaggatttaaggatattatttttaaatcttttaagtctctgtaaataacagtgcttttgatttgaatatttgctgattacagaaaatatcacctgtttacattttaaccttccctttcttcccttcaaaatgacaaatgaaacattacaattttatttcctttaaataaaatggtgtttatggtattagaaattttatagccttttgtttgttctggcactgggtagctcaacagggaggaaagcattcctacctaaatttttttcacttatactgtgtatgaggaattgggagaagtattttaatgaatgcaaatccttcaaactccttagttagaaagtatttggtattttcagttattatgctagttaaatgacctttctccgtgtttctcatgtgtttactttttagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattcccattttctataatccttcttttagataagatttatttaaaaggggatttgagttttacatctttcatagtctatttaatgtggcatctgtatttatccccaaattattttcttgtcactgtcctggttgtgctcaatgcatactttttgctacctgtttgatattaccacattaccctcttgaggcctgacattcatttgatctatagccagatgaatcagattggtttcccaatttttatagtttttaaaacctttatgctgacaatttagagggaaagtgtctgtttcttaacatgaaagaaaaagaggatagtgtaggttcattgtttcttctccctccttcgtccaattgaaattgatgtgaaaatgaatttataaacttttaaaattagaatgtatcagaaatagacatgcatttatagtttgatgtcttacttgataggttacttacttttttcttttttgttttgttgttttttgttttttgttgttttttttttttgagacagattctcattctgtcacccaggctggagttcagtggcacatctcggctctctgcaacctctgtcttctgagttcaagcaattatcatgccttggcctcccaagtagctggaattacaggcgcatgacaccacacctggctaatttttctgtttttagtagagacagggttttgccatgttggccaggctggtcttgaactcctgacctcacatgatccgcccaccttggcctcccaaagttctgggattacaggtgtgagccatcatgcccagcctatacttagaatttttttttttttttttttgagacggagtctcgctctttctcccaggctggagtgcagtggcgcgatctcggctcactgcaagctccgcctcctgggttcacgccattctcctgcctcagcctcctgagtaggtgggactacaggcgcccgccaccatgcctggctaatttttttgtatttttagtagagatggggcttcaccgtgttagccaggatggtctcaatctcctgacctcgtgatctgcccgcctcggcctcccaaagtgctgggattacaggcttgagccaccgcacccggccgctagaatttttgaagtatttgcaactatgtactttttgaaggaaaaaaaccttcattctcatgtcgctatgtagaatattcttcatcattaagcagcaccataactatcatctagtgattagaattttatttttccataaaaatatgaggcactgtttttgttttggacaaaactacacatttttctttaaagatttacaaactcctatgtaatttgaaagttgctatactgggagtaatctgaaaagcttagaaagttcatttccttttatatttccatcttaaatgtgctgctttttctattcgaagtttacaaagaaacaagtaaatgggatgtcgtgcatgtatgcacatgctcacacgtgtataaatcagtgtccatttaaaaaatattaacatttaggtaaatagagtattacatattatactctttagatgatcaagactctaatctgtgttgacacttcagaatttattaaaagatcttcccttacttttcagtaatttaattagtttctttaagcctgacataacgaggaggagcccaaacaacataatcaagttttaccttgggaggaaaaaaagttttacctgctagaaagaattaataaaatattgctatacattcacttagaaagttcttctcttttccagtatgaacttgctttcatttgtttggtagtaatcattcaatttgaaaacatatgcacctcatgaatggccacataactatgtaataaggttttatttctcagaaaaggtcctaatattttattggtttatagttttaagaaatttttcatgataatttgatatgggagagattaattttagtattgttgacattggtgggtggatagctgaacttatctaacttaggtgtccactcttgctatataaaggtaatttgataagtaacatgaaaccagtatttcgtagtctttgctgccagagtaagtgatgcaagatcttgcttttaaagctagagttaatactgagatgcataatcaactgaaaagtggattagtttttttttttttttccttttcaacatttcttactctgaaaccatagttgttactgctcttctgggggtggggtgagtacttttaataaaccagttgcattactggaaatgtgg

SEQ ID NO: 137939 - DNA, 1085 bp, Homo sapiens
ccatgttgcccaggctggtcttaaactcctgagctcaggtgatccgcccaccttagactcccaaagtgcgctgggattacaggcgtgaaccatcacacctggtcacattttgaaaacctgtgtactaagagtttagagagaagcattctcatgtactgtctgtatattgagctatttaaagggactttttcactccactaacatttcttatagggtattcagtgttgtggtttgtatactattaccttcataagttgcttacatacttgtgaccctaggcctttctgttggtttgttcttaaatatttatattcattaccaaactgatttttccagtatggttgtaccagaatgtcttaaatgggaaattttgtaaataataccttattatatcattgatgttcaagaatcttaaataaaatctgctacttttttataagctttctgattctatgcagccaagtagtaatagccttttattacaaatagaagttgttaaaatacgttagcaggcatgtgattacctgcctcatgccatgtaattacctgcctcatgccatgtaattcacagtatctatacacttattttacaccattgccacttgggttttgggttataattggacctaatttattaatgatcatagcaactgtatctaaacaagaatctctttattattcataatttgatgattctatagttgtctgattatgaagataacagattttcattttctagtgaaactaatatgaccttagctttgactaataatctgtcacctcctgtgttctgtcagcaatttcttgtagtagtgttaatgttaagacggcatatctagggaacttctagttaaacatggaaggttggatacatttgtttatctcttcttcccctaaccatactaaaatgaaagtgaagaaataaaataagcataataagtatacagccgtaaggacaaagataataggagaaggagtaacagtggacaagagataccagcaaattgggggaaactggtaagtagacagattagcagagctaaaaagttgtgtgtcaaaagagagagacatcaatttaaaaaaaa

SEQ ID NO: 137940 - DNA, 1481 bp, Homo sapiens
gttatcattgtttccccttctgtccactgagtttgaactaaggaaaagcaaatgttcctatactctttgaatctccctatctctggattattttgaatttctctgtgtcctgtcacttaagtctctcctcattttagttttgttctcattggtaaacattatatgtggctatgttcctgatatcacaagagttgtttatttgtacttgtatagaaaatatctactttctcccagattttgtaacttggagaaatgttgcctaagaatttttttccacgataatgtgatcatagttgccttctctttttgctttctcctcttccttttagcagatattagattaggtctaatatttggtatcagtataaagttacatactaaaaaaaaactggcattttttatgttcctttaggaaatgtatgattattttaatttacatttgcctaatgtgtacttctttttattttctcctgttcttcatattaccaaacttgcagactattcttggtgccatgaaggatgtggtcaaacacagaacttctattttcattgcacacagattgtcaacagtggttgatgcagatgaaatcattgtcttggatcaggtaagacatttaactttaaagtttagtatttgaggaacactggaaattgttatagatacaagaagcttaaatattgtttcttacattatttggttgagactgaatcctgttacgattctgtttttagccccttttgattggaaataatgcatgtcacttccaagaaggaataaagtatattaactcactctttattaaagtattataagcaaaagtttaatcaggaaagcattaaatcttcacgatagaagcaggtttttcaatggtgcatatataaaataacttttctgccttcagttttgctctgaatagactctttgcttggtgtctttgctgtattatatgtttttgtttttctaatacctgcacatacccttgatggttaaaagaaaattaccataaaataaagtggtcattttcaaacatggtcatttttattttatgtttttccttttcgggaaagtaagaaaaaagatagcctgctttatctcttctaagggaattactatatgagtatactgtaaaagtctagacaaatcagagtaccactattgtgatgggtagatttgaaaattgcaataatttttcttttcttctttctgtaaggacctcttctccccacacccctctagtatttgattatttctaacattatgcagttttccaccctgcattcagccttttctgtaattatttttcccttctaataaatatatcttcaattctttatcattttggtttttttttttcctttttgaggcagggtcttactttgtcacccaggagtacagtggcgcgatctcggctcactgcagcctcgaactcctgggctcaagcaatcctcccacctcagccccccaagtagctgggactata

SEQ ID NO: 137941 - DNA, 1050 bp, Homo sapiens
atactggctgaatgctacttttttatcttaagagacgaattcagttattcatagtttaatgtcttcaagtttcaggtttcagatattgatttttttggcattgtcaattctgtcattgaaatttttctgagattgcagttcattgagaattatctgtaatataaagtaacatataatgagcatgcttctggtagaagaataatagtagaatcaaagttgttaccttactgcctcattctcattcttcccacctgctatgaagtcagaattcagtagtgcattcatgtttcagggaatataatttgtcaaaagatattgtatatgaacttcaactctacaactcagtaaaatgaactgtgatcaggagaataaggaaatgttcagtgtattacttggtggttgtaatcaatggaaacactaaaaacataaaatatgcatgcactatgcttccttaaagtaaaattttcctttaccaggaggagaaaagcaaagagtagcaattgcaagagccattttgaaggaccccccagtcatactctatgatgaagctacttcatcgttagattcgattactgaagaggtaagttatgattaaaatataaagctcttcaatgtttaacttttctacttggaagtttcagtaaaatggctgcattactttgtattttgaataaacttcaatagtaagtgctatagagcaaaatgcctatccccctttttccatatggcaagtgttgatggtaagaataccaggttgtattgaactagagataccacagtgttaagtccatttgcaaatgtgtctccttttggaactatgtgataccttatgctgttgttgtattgcccttgcatcttacaaagctgtaggaatcacctgatatgctgacaaaggaagaaagttttagtctctctcctattgccacttaacactcattaaaatagtcatggaagtgattgtgaaacctgtgacatggtacataccagaaagcctttcacttatcatggagcgactcatgagatgcaagtcaggcacacacaacctgcagt

SEQ ID NO: 137942 - DNA, 3327 bp, Homo sapiens
tatttccatttaacaaatagttactgaatgcctcttatgtgttctaagtgctttcacaggggagggtggtaaaaaaagattactttctgatccctgctatcccagaattttatactgtaccgagagaatttaagtatgcaggtgactaaataagaaggcataatgttgtgagggtagtgggaattgtcaattcagagtctcaggggaaggctttgtgaaggaagtgtcattgaagattttgttttaggtcgggttgcaattagataagcattcagtaaatattcgttgggtgaattttgtggacttttcaaatacaattcattatggaaaactgcagggatatcatagtccaatatattgagtcaatttttaaaatggaatctacagtacaaaattgtattcatacatgaagtctgatgaaaagtatactaatcacttaagagaataaattctaattatacttgcctatagttatttttatatattttgtagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtaatgagtctgtggctatcacatttacaggctgttcaacttttataaataaagattaatgaaaggaatgtgcatgcttatcttaattataaaggatgttaaagtgctttcacatccttggagtacttttctctgtatcagaatgtatttacttgatggtttgataatggttttttaacttccttttgtttagcactgcctcactcactgattgggattactgtttggaactacctgttcttttaagaacaacttttttttttagtatctagcttttctaatttctcttgcagacctgtaaagcaatgtaattgatttagtgtttagttcaaagcactaaactgcactcttttttttaagaattaccaggaaccttttaatctttctcctcctttttttagttgcaaaacacttcaaaagtaaatgtctgtccctcctttctggaaaccctccccacccccactcagttagtattcattcattcactgtgacctaaatatgtggaaaatctgtggaaaacatatttaggtcacaacaacattttgttgttgttgttgttgtttcattttgtttccttcaacttgatgtacatcagaatggtttatcatccttaatcgtgatatctattttctccaatttttaatgtatactaatttttaaattcctgttttacactacaaagaaaccattgctagtgtcttagggaaaaaaacagaaaatttttagccttcaatttctatcctcacttaaaccattcttttttatatattatatatagtgtataggtgggtctttcccattcctaacgtatactaagttccctgtattacctaaatcgtggattaatgctttgaaattgagttgacataagagttgttgctgattaagaatattttgttccgtcgtaatagactataaacctatcgtaaattggaaaagtatgtaacatttatctaaaataccctttttttcttctgccttttaaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagtaagtaatctatatagtaccttttcaaaagtatgtgaacatcatcctattagtaggattattctaggaatattcctacatcaccacattagcaaaccaatttattttacttgcaggaattgtcaggggtgggggtgctatcacctgtattaagaggttgttagagctttcacttctgtgtttaaaaacctggccacgcatggtggctcactcctgtaatcccagcattttgggaggctgaggcgggtggatcacctgagatcaagagttcgagaccagcctgaccaacatgaagaaaccctgtctctactaaaaatacaaaattagctgggcgtgatggcacatgcctgtaatcccagctactcgggaggctgagtcaggagaatcgcttgaacctgggaggtggaggttgtggtgagccgagatcctgccattgcactccagcctgagcaacaagggcgaactccgtctcaaaataaataaataaataaataaataaataaaatcttacaatgttaatgaagactattatactagaaagtaaattttgttaagttgaattatttgtacttacactgaatttacttatctaataatgacatggaatatatgattgcctctccttgcatcctcagcccctttcctcccctgcccattatcccttctccctccccaaccccacctcaaaaaaaagttgctcagaaaccaaaacattcagggtttgttttaccttagccatgaagcgtgagaaaacaaatctttaaatgcatgcttggaagtggtctaagtccacttataaacctccttcttttccattatatcctttttctttctgtgaattagaaaattgtcttcgtagctgtactctaggcagtgcgtaaagtggctttttttttctcttccctgctaggacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggtgggtaatttagttatttgtaaaattctgtattataggctgatgattcccaatgtaatatttctttctttatcaaaatgattactgtggtttaaaactggggtttcctaacattaataggagctaaataacctttcttcatctccaatttcaggaaaagcacaatagtgaggctattatttcgcttctatgagcctcaaaagggtagcatttatcttgctggtcaaaatatacaagatgtgagcctggaaagccttcggagggcagtgggagtggtacctcaggtatttaaaaacagaaaaaaacaaatttttggaggatttattgggttgatcaatccgtaactagaacagtttgaatcaagggatcaacatatgctactgaagtagtcagtattagaccctaccagtgaaattctggtatcaaaagggattttttaaaa

SEQ ID NO: 137943 - DNA, 2373 bp, Homo sapiens
gtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttggtaagttaaacatttttcataacaagcttttatcttaaattctcattagtagcaattgaatatttgaagctgttgtactgttgcatgcccatgggcttgaaagcaaaattccatgatgccagaaatattatgcagtttaattattttgccacaagcttcaatggactgctcaaattctttatcgtgttgttattgtaaataactgttcaattctacacatagattagtcatcaactagtacttacaaggtttttttaaagcagagatttttgtatatgacattggactaatatgctcagaatatctaggtttctcatcaccattcataacattttaggcaatttcaccttttatttttttttctctgtttcaacttttagcttcagggggtacctgtgcaagtttgttacatgggtaaattatgtgtcactggggtgtggtgtacaaattatttcatcaccaggtagtgagcatagtacctaataggtagttttttgccttcactcatctgccaccctccaccctcaataggccccagtgtccattcccctcattgtgtctgtgtgtactcattgtttagctcccacttataagtgagaacatgtggtattttggttttctgttcctgagttaattcacttaagataatggtctccagatgcatccatgttgctgcaaaggacatgattttgtttttcatggctgcatagtattccatgatgtacatgggccacattttctttatttagtccaccattgattggcatccatgtgtttgctattgtgaatagtgctgcaatgaacatacgcatttgtatgtctttatggcagaatgatttatgttcttttgaatatatatacacccagtaatgggattgctggatcaaatggtaattctgttttaagttctttgagaaatctccaaactgcttacagtggctgaactaatttccattcccaccagcagtgtataagtgttcccttttctctgcaaccttgacaacatctgttattttttgactttttaataatagccattctgactcatctgagatgatatctcattgtggttttgatttgcatttctctaatgattagcaatttcaccttttatagttaaaaatatatgtatatattttttattcctctttaggctttttgtactatcttcctattagtatttgatggtactactgatgtagcaagtgcagtttgactttcttcccttgttgcctaaagtagattttctaaagtatttgatttttcacccatcattcacgtacataacttcacgccaccatatttttgttaaaatcttttgaccgagatttgctgttgtgtattacaaactgtttgggaagaacaataactgtttcacgtttcttctttggacttccttttctagtattacaaatgcggtgcccagtttgctttggtaacccttggaacacttggtacatacacagcattcacagttgcagtcacacggtggaggtaatttattccctagaagccacataaaatttagaaattgttttgcttttataacatgtatttcatgcctatgcaaatctttgtcttacagaactagatttagaatagaaatgaacaaagcagataatgatgcaggtaatgctgctatagactcactgctgaattatgaaactgtgaaggtaatatgtttaattatactttcctctgcctttcacactgcactaagatttgatctaccatttaatttaataggtactgtaaattagagcttcaggttaggatatgatctctaggcgtgatggaataatactattttattgtttgtctttagaaactatcctctttccttctcagtttttgtttggcactatcagatttttaccttctgaattaatttataagtgatcataaatacagtcatgcactgtataatgatgttttggcatctatgatgttggtcccataagataataatggaactgaaaagttcctgtcagcaagtgacattgtagccattgtaatgttgtagcacaattcattactctattactcatgtgtttctggtaatgctggtggaaacaaaccagctgcgcgacccatcatttaatatttgataatgataaactagtatgttaactagtatatgtatttttacacgtt

SEQ ID NO: 137944 - DNA, 1962 bp, Homo sapiens
tgagccgagatttccccactgcactccagcctgggtgacagagtgagactccatctcaaaaaaaaaaaaaaagcaaagaagaagcaagaacctaaggttatatggctacaggggaatcagatttgagaaatttatgctatttgagacctgccatatattctattagattttggaagtcagaaagcttaatgtttaagcactttatctcatgttacattcttaaaagcatcccaacatgtgctgtgtattttaatgatattgtcgaatactagaatgcctgcttggttggtaagactcttgtatacgttaccttggaatcttgataagagttacatagcttctatcagttatagctaaactttgcaaagatagatggcataataatggagcattaacaagatctgggatttcagtgtttttattaaggcttataaaattgttttcacatgttattaatgtgcatcaatttaatttcttcaaagaaactttgggagtctgacaaactttctgttcctaaatgatggttgatgttttggatactataactgcagaaaatatagaatgtgaatgatgaaacatttgccttgaatatatgaaaacatcatgcttctaattttctttttaagttttattttgatgtattctcatggagaaataggttcattattgaaagcttagttttgataataattgggctttgttttatgtggtattggggcaaagaagctttctgtaggacaaatggatttatcaatgttttttcaaatggtgaatcagccaacatatacttgtaattcatctgcttttgtgatctggcttgctgtgtaatttagtttaccattattttgatgaccaaattattttaaaaatatttattgaatgcctactgtataagagcattatattcagcatgggtgggacaaaaagtaaaatgacacagaccctcaaggatccagtaggaaagggaaatatatacacaaataactacagtgtaagacagtttgccatagtgtcatgagctttgtaggattttagataatggagacagcatttttgagtggcagatctgggatgatttcatggaagcagaagcatttgactaattcacatagcttataaatgaatattaacatggcagtgtgaagtatgaagcctgaaatgacagctctcccaatgtcaaagatgttgtctttatgaatggggaaaatcactctaataccagtaagtggtaaatatgtaaacattaccataagtactaatttaaggtaaatatttgtacttttataaataagtattttgtgtataatgggtaattgatgtttttatgtttttaggccatgaatattgtggttcccttcatgtttaaatatgctgtagacagcctcaaccagatgtcgggaaacatgctgaacctgagtgatgcaccaaatacagttgcaaccatggcaacagcagttctgattggctgtatgtgtgattctttaatctgtctacaggtgttgactttcttcaaggaggtttcatcatatttgagcagatgaccttttcactacaaacacaacttagcgttttggatgtttgttgttttatgtgagatgttttgtatgtgtttttaaaaactattctgtatgatacactttcaaaaaattccatgataacagtagcatttttacaagttctagaaaacaataatataaaataagacattaaattcataacaaccacttctaatagttaggctttttgtaacatccatttccacaaaggtcaattattttcttgctggcattgttagctattaaataggaaatagctaaataaaaatatatatgtacataaatgctttattaaaatatattcattagtaatgacacaaatctacaatttgaaaagaacagaatatgaatgctgtgtgtcccatgcattagaaaggacactatgagatttgggagacattagtag

SEQ ID NO: 137945 - DNA, 1059 bp, Homo sapiens
taattgagaacttatacacactactgttcttggcattgcagagtgttcagatatgaacaaagcaaatttctttcctcaaaccatatgggataaggcaagctttattttattgccctaataaaaggtaggtcataaatgatttaaagaagtgccagtcgggtgttgtggggtttcagaagaaagttaggaaccaccatcatggggagttaggaaaggtttcacagaggagatgacatctgagatagaccttgattgatgagtaggattattacaggtgtaggaataacatgaaaaatggcctagttgtgagagagcatagtatgtgtacagaagtgagtagtctatcctggttccagcgaggggaagatgtttcagagaattcggaaataagcttggaaagacagattagagctcgtaaatgtgaaatattgtgactgtgagacagaaaaatgtatttaattatgtgggaagtgggaacctgtattttgaatagatgagtaataaggttagaactgtgttttaggaaattaatctggccatgtgtaaaagatgaattcaagtggtgatagacctaaagtagggataccatttatttcacacattcattcagcaaatgtttactgaccagttataaggctcatatgatagtctagataagaagtaatagcaatttgtactgaaatagtagtagaaattgcaacatggaggaaaatacaagagatactgtgcagtaggggagatagagtcaacaatacttagcaatgggtcaactgttagaagttaaaaaaaaaaaaagtaggattccaggatgagagaataagaatgcctttaacaaaagtgggtataatcagaaggtcttgtttggggaaaatgaagatcttggttttggacatgttaagttttaggtactagcagaacacccagatagagatattcagctggtaatacaaaatgtgaaacaagctcaggaaggagcccaggtctagagagattgagatgacagttgaaacaatgcaaattagtgagttcaccaaggaaaagaacacaaatagaaggaaa

SEQ ID NO: 137946 - DNA, 1086 bp, Homo sapiens
acgttattgaattatggttatgtttgaaatgacatgttattcactgctttgttttctctctttcaatagttaaaagatgttgatactcggaaaatcataaaagcaatgctttcttatgtgtggcccaaagacaggccagatctacgagctagagttgccatttcgctgggatttttgggtggtgcaaaggtaagaaattatgcattgtttggttgctctaactaagaaatactacattttctagttatgaatcctgggcctggtgtaaatcacttttggggtagcatgaccaacttttaggaccctcatttagtttacataattattttatgcagtcattagaaattatatggtaatgtcctgtttatctctggatcagacttctcacagaattagtggaattcactccttgaaaccgttgtgagatataggagcattgattgtaacaaagcataagcacctttgtaaaagaagcttttcggagcctctttggctccgaaataatacatatttttggtaagcttggttcccagatcccagtaaattgaaaagaggatgaagccattttaggaacactgatagccataagtaataagcaacagcttaatatcaagagaaaagctaaaaaaacaaaacaaaacaaaagccacaaaacctgactgttttggtacgttcagtataggagccctctgcatttcagcagccttctcagtttgtcattgtactatataaggcaaagttataatgatgacctcgagttttcaagaaaataaaaaccttgtttcaaatttactcagatttttttttcttttttttttttttgatacagagtctcactctgttgcccagactggagtacagtggcacaatcttggctcactgcaatctctgcctcccgggttcaagcaattctcctgcctcagcctcccgagtagctgggattataggcgtgcgccaccatgcccagctaatttttgtatttttagtagagatggggtttcaccatgttgaccaggctggtctctaactcctgaccccaggtgatccacccgcctcgacctcccaaagtgctgggattacaggcat

SEQ ID NO: 137947 - DNA, 1155 bp, Homo sapiens
gtgactataattagcaataacgtgtatttcaaagtacctggaagagagaacttgaaatgttcccaacccatagaaatgataaatactcaaggagatagataccccaaatactccgatttgatcattacatattctgtacattcaacaaaatctcacgtgtaccccataaatatgtaaaatattatgaatcaataaaaactgtgcctcggactctgaaatgcctctttggtttggtctccagttaaaaaaatgcattatttttcaaactttatagtttatcaaaactaatggaattcatgtactttacagcttaatggactcataatgcatgattacataacttcagaacccattttgttaaatgaagtggtgacattttatgcactattaagccaactagaataattttcttgctcttagccataacttcactgtgtccttattgaaaaaattctgggatgtgttgtagaaggttttgatagaagagagtgtttctaaagatacgtgaaagcagggcctttttccattattccatcaagaaaagtaagacagacaaaactcatgaaatgagaaagtggttgaaatgccctagtttgtgttataatgctttaaattatatttatttcataatagttctattgggaaagggaattttaaaattactgccttaaaaggtcttaccagttataagagcatgcatatgtgtgtgtataaaataaaacattaagaactatactttcagcatttcatatttttgtcatcttatgtatttaaagcagttcaggaagataactcttgtgtttttacaatatgaacaattttatttctaatactctttatgcgataaactgcctaaaagactagaaaagtagtttgctgagtcctagagggataactataatatgaaactaacctgtattatataaggtactgtcctgggccttgacagtaccttatataatacaggttagttttatattatatgttgacaatttccccccgttccttgctttgcaaatctactcgaaattatataacttccctccctaacccctgctgaatatatgtgaattataaaaagtagaagctagccaacaacaacaacaaaaggccataaaaaagtatcaatgattccacccactcacagctactgtt

SEQ ID NO: 137948 - DNA, 1194 bp, Homo sapiens
aaattgtaaagcctttcctgacaactcatacatattttcttctcttatcccaaattcactatatgtatctctccaacaacacaataaaaattttccagttatactctggattttttagacatcgactgaactcgctagtttttgaccttctttttataaatccattgttatctttaatagtactgaagtggtttcttccttttattgcagttgttgggttgaggagacagttcttttctctggatagtttgcttatccctgaaattatggacacttccaaattttcttctagattggttctttagggagaaaaccttcagcctatagctcatatttttacaaaacagcattccaatttttttttatgttttttagttcctcactacaagttttgtccccaagtagtttctttcaaaatcagtcccttgattctatgaggtattacatttcttgcttttagaatttaggaatgtctgtaaaaccagaattcttagagaaattcctcatcggctaaggaaaaggtgattcttctacctttatcaaaagatcattttttttttcttactcttcattttcttatcaagggccactgggcttcactcccttgaaaagaacaagcaacggatagaaaaataggctcttgcttcagtgcttgacctttcctggcgagaaatagaaacttacttacctgagaaacagaatgtgtattcaatttattaatatacagttatctttaatatctgaaaattctaccaaatgagctgctccagctgttttggttttttattctcaggtcttgtctacatcgttattaggtatagctgttcacttgtagtacatttggccatgaggcagtgcttctcttcctcaaatcacactgtcaaattgagcactgtcaattcatgagaagtataatttgtggctttccagttacaccctactgagtttggtacttccagttttatttgtgtacttatttatttatgtatttgtttttgacccaccatactgtgattgtgctatttcattgtatagatgttcttttcattatttcttacctgtccagcctcatgaagcttatgaagctgtatgttaataccaaataagtaaatatttaaaaatctgtcagaagttgtggtgatttaattattaggtattgcctctaggatattaataagaatttcccatcatgtg

SEQ ID NO: 137949 - DNA, 1026 bp, Homo sapiens
gattggcaggaaacagttttcagtgcttttttccattctttgattcctagtacagttctttcaaggaactcaaaacacttcacattcatgtttctgtcccatttttgtacattatccttcatagctgatttttaaaactgcaaagtatcataaaataaattttaaaatattaacccaaatagtgagatttgtttgtctttgcattagtctttggtatgatatttgccagttttcaggatcatctgtcaccaaggcctcttaaggatagttgctaataatctaaacacaaccaaaaacatgttgacttaataaaggagaagcagctacttcttttaggctcaagcagtataaacttcaagacagtttctttctgctccagtaaaataaagcaacactcatcgtaatactttatagttagtctgtagccctttgtttgttttcccttgccatctttgtattagtttagcctttttatcgaattggaatcatagaatcatatagattggagaccatgtcagaaaatagtgtggagttgtagttaagagcttgagctctggagccagactgcctggatttgaattgtggctccatcacttgctagtagaatgaccttgagctagttacttaatctctgtgtacttcagtttcttcatctgtaaaatggagatgataattttgaaggggatttaaatgagttaactcctcacaccatgttaaagctcttaaatagtgcttgacacatagtaagtgctcaataaattttagctgctgttgttataatgtgagattgtaaggcctgtcctctaccataatccatttatttaaaaagtatatattgaataccttctttgtgctaaactctgtgttaagtactggagatatgcaagacaaaatctctgctgtctagaaacttaacaacatggcagaatatgtaaactgccatgtagaagttttatcactgtgacaaataatagattttaccttataaccaactgaaatctgtagtgctttactttttgtgtgctt

SEQ ID NO: 137950 - DNA, 2722 bp, Homo sapiens
catggaattttttaagtgtagttgaaaagaaaagtgggtacttttagaaaaaaaactgacaggttttcagggctcatgtagacctgaagaaaaatgagagggagcaaaattaaggcattttttgtgtgtgtatctttttggggggggattgggtagagtggctttaccatattttttgaaaaagtccctttttttcatttgaggagctaattcaattggtttgggcaaaagcagcattatcagaaatacacagttggattctgtatcatgcctctgtttagtaagaccacggggagataatggaataggaattagaaacctcaggcttgagtgcccgtagcagtattaaactaagaatttaaaaacaggcagaacaaaaagaaatcagtgaacacctgaaaagggagacacaaaaatggagtagcaaggagataaagagaagacatccatgctgaggggagcagtagattgctatcagaaattgtcccaaataactgtgtttccctacctctgaagtagaaattagcttttagcatgctagaaagagactagatatagataggccaaaaggaatttaaaatttacaaagccaaatacctttttcaaagtaccttttctatctagtttgttaagcaggaattcattagatatcatttgtcagccctagagttgggtttgtgttatatcaatgttctcttagcctacactttctgttataagcagattatgtctgatatatcctacttatggacggcttgtatcagactttgctggaatgcttataaagaaaaccagggggtttgggatatgacctgcatattgagccatacagaatggtccaagtaaatgaaaatgctatcttatatgagtttcaaataattttcgaggtaatttaatcaccagtggcaatctgacacatgcataaaaagtaacaaacgtaaaggagcattatagaaaaacataatgaaattgtccagctatggaatcgaaagttaagaaatgtgcttgagggttctcttccaagtccccattagtaaatataagagcaagcaatttcggtattaaattactgaaagttgaaactgtaaagaagcagaaaatattccaattctactttctcaacttcttttattacattatctcatcattccagctgttgtgtggaatgtgtgataatttctccattctgtccacaaacacaatagggttaggaatattagaagtactcagagattcgtaccaattttctaaagatcttgggttctaataagccagctcaatgaaattattgtgtctaaaatgtgtctttggtatattcactcttaatatgataaagaaattcctctttgtacattcgtccccaaatttcatgatttaaaaggaattggttctggagttttttcttaacttttaatattcagccattggttttaattgccctgattttggcaaatgctttgcaattctttgttactcttagtagcaagcagcttggaatctcacatcacttagctaaaacttatgaagcagtgtgcaattttcttgatgacaaaaatgttatgataaatgaacctatttgaatgggaacaatgaaacttcatagaagttgcttaaacaaacataaaaaaacttttgtcaggaccttttcttctgtcttttaaataggccttgctgttggtgttacgtacccagagatgtgaacatttggtagataaaggaaaaactattagaggtagaggggaatcccatacatattttttgtttgtgtgttgcttttttgtggtggtgctggtggagattttttggtcgttgtactttcttttgttttactctgtcattctcaaaatccttggaggttgaggggtgttagaaattatttagagcaggggtcagcaatcaatggctcttgggccaaatccagcatgccacctatttttgcaaggctcctgtgctaagaatacttgaaaacattttttaatggttggaaaaacaatcaagaagaatattttgtgatagatgacaattacatgaaattcagatttcattgttcatacataaagttttattggagcacagccacacttgttcacttgcttatcatgtatggttgctttcatgctacaatgacagagttgaattgttgtgacagaaacgatatgcctgtaaaccctaaaatatttactgtctggaaaagcgagctcaagaaaacaatctcatttaccatagcatcaaaaagaataaaatacttaggaataaatttaaccaaggaggtgaaagatctatatactcaaaactatgaagcactgatgaaaaaaattgaagaggacacaaataaatggaaagattttaatatctttggatttatggaaagatattttaatattataaaaatttccacactacccaacacaatccctataaaaatttcaacagcatttttcacagcaatagaaaaaagtcataacattaacatggaacaatcgaccccaaatagccaaagcaatcttgagagagaggaacaaagttggaggcatcacagttcctaatttcaaattacaaagctgtattaatcaaaacagtatggtactggcataaaaacagacacatagaccaatggaacagaatatagagcccagaaataaacccatccatatacattcaactaaacttctacaagggtgccaaaagtacaaaatgtggaaaagatagtcttttcaataaa

SEQ ID NO: 137951 - DNA, 1027 bp, Homo sapiens
tgtaaacctgtgccaagaatgccatcatgtttgaaacacaattaagttggatataaaactctaggctcaacattctttcctttcaatgctttgaaaatcctactccattttctttttgcatctagtattactcttaagaagtctgatgtccatctgatttctttttacttcatgttatttgtaatttttaaaataacttttctattttttctatgtccccatttgtctatgtgactcttagttatttgttttttttgagattcatttagaatatattattttacttacatgtttttaaattttactgtcaatatgtctaggaggtagttttttcttattctcttggcactctgtggactctttcagtatgaaatattttatctttaatttttgtacaatgaatctctttatttttgtaaatatttttatctccattttgattttttcttttcctttgcttcagtaaatagttgttaatatgtacacttttgtgttgctttatttatattattacttttcatacctaatatttccattctcttttcaaggtactgattctcccttgtatctcttttcccagggtctttcttcctaggctaagtttaactctttttgttgcttgcccatctgttatcccttgacccaggcatatgcctttatatgctttcaacagaggaccctatggaaagccacttcagccccaagagtgttctgataggtacaagataagcccctgagccagtccttcagggagctgccagacaagtcaaaaagtataaccataattcttcaaaaacaagtccatatttccttctctggtaccagcaagctataccaagaatgcaagctgccatccccattggggaatggaaggatggtatgtgagtgagcacaaatgtcataacactctcttctgatacttatttagcaacttcttttttcattatacactcccctggttgttgttagtttttcattagattccagagttctggaaaagttgattgagatctgacagtttttgcta

SEQ ID NO: 137952 - DNA, 1150 bp, Homo sapiens
tttgtagaaattttaactgcacactgtattttgggatgttcattagtcctctgattaagttttctttacaatatctagagagggatggatattaaagtagggaaaccgcatcctaagggtatagttccttaggtgctgatgttttgggagagcaacttttaaacttctgcttttcaaagcatattagaaaaagacaaggtgaagcttcgattttggtttacttataaaattgtttttactgatcttgagtaacttatactataatattgtaatatattcatatttttgagtgcatgaatgtttgctaagtatgaactctttcttcaactactctgactgtagtgacttaataactgtgcatgtacatgtgtgcttgcctgctacgtttgccataacaccacagattgggtggcttatacaacagaaatgtattttctcacagttctggaacccatgaagtccaagatgaaggtgtcagtagagttgatttcttctgaggtctctctccttggcatgtagatggccatcttatacctctgtcttcacactgtcttttccactgtttgtgtctgtgtcctgatatcctcttcttagaagtatactggtcatattggattaaggcccaccttaatgacctcattgaactttaattacctctttaagggccctgtttccaaatatagtcacattctgaagtattagaggttaggacttcaacatataaatttgtgggggtggggagtacacagttcagaccataacaatgtgtgtatgtgtttgtatgtgtgtgtatgtatatgcaaatacatagaaaattggaaagatatactccagtctggtaaaagtggttacctcgggggttgggggggggtttgggatgctaaaaaacaaacaaaaaaaatttaatttgctattatggatacacagacatagtttgatatactgtacttgtttttacaatgagaaaaatatttcatgtttaagcttttcaattgatgaactgacctttttgagtaggttatattatgttcatttatttgaagtccaatttgttttgtctgctagtagtaatgcattttatcatctctgtaacttttattttatttgtttattttttattttttatttttttgcgatggagttgtgctct

SEQ ID NO: 137953 - DNA, 1014 bp, Homo sapiens
cctcatctgtgctctcttgactcccttgtaggatttgccactagtgagtaaagatacttttcaagtctttatttaatgtcatttggtcttcacagtaatccggttaggtagatgaacatttctttgtagtagcaatggcctcttctgtccttttcagtcccttaacttctgccctagttttagacccttattactttatgcatgggttttgtccctgctttcagggacttgccctttcaatccatcctatacagcacatctagattattcttcctaaggcatgacttttatcccatcacttccctgcataaacttcagtgggctttatatcttagccttaaaaatttccacctaactagattgctagccatattgtaaactgtttctctacaaataccctgtccctccagtcaccctatattgttccctgttccttggaccatgtgcttttttgtgtctgttcttttttttatgccacaccctatgtctgaaatgccctctctctaactggtgcctatttttcaaatgttagttcaaaggtcagtccgttccctgaaaccattccttataagctaataagactttgatttctccctcctctgaactcctacaacactttttcctacaagtagttatgtatcttgtggaggagataagattttatgtgcctaaaatgctaatatattccaatcatctttttgtttttatcttccacagagctaggcacggtatgttacatgtaataggtaatcagaaaatatatgtaaaatgaatgattaaactctataaccaaaccaaagcaaaaatctaacataataattaataatatttgctccactgctatacatttggaattgaaagctaactttcttcagggcaacctcataagtttgtccgttgcatttctgtcattaggcatatggtaccgtggtggagtagcatcactgattgttgtcagttttagttcaataaccaaagcacacttactttttatcctaaaatttttgagttact

SEQ ID NO: 137954 - DNA, 1147 bp, Homo sapiens
agtttaatctttccttaattcagaagggagtgaagataagaatatgcatagggaaaatggagagaggggagcgtgacattgagttggaggaggtaagagagtattatgagagacaagatggggttgacagatttagcagatacaatatttgggacacacgcacgaagagatgattcgttgtttatgtaaaattgaaacttaactaggtaggcatcctgtatttcatctggcaactccaggaaaagagaaaaatacagtgttactccaatattcccggttgtgtaaggaaaacaatcaaagctcggccctaaggaaaaacaaataaaagaggctgtgcgaatgcatccgaatcttcaaacagaatccatttccggtctggggccctgggaaaacaagaagaggagagacaattaaggtagccgaattcagtccgccagtgtcccataatcctcttctctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccaggtgagatgccactgacatggaagaatagggtgaagggcaaggggacctgtagggaaaaggttgccctcctgacctcggggcagagagagcaccaagaagaaagtcatggctaactgggagcagcagtaagtgaaggaaattaacgtcagtaatttgaggaaagggcgaagaagaaaacctttgagttcagcaaagggaaacggggcaggaggttctgggcagaggacacctggagcgctggaggctctcggagtcatagtttttctctcatattaagagttggggtagacaccattcccagcctgcttgcctttctaaagacgaggaagactggattattttccccaattagtaatggaatttgggacagtttatctgtggttcagattttactcagttggaattagcaattcggagagcactgtaatgacagcaagctatctataaacaggtggcgccagttaactcccttgctgacaggcgtgcttcttgataggc

SEQ ID NO: 137955 - DNA, 1090 bp, Homo sapiens
ataaaaattctgagctagaatggggaaagatgtaagtaaagcagtctaagtaaaataaatatgcaaaatgaagggctaggtggagctattcttttaaaatcttaaaaataaaactcaggcatttaggaaagaaatctgtgtagatgactttttgttaagggcttgcttgtcaattcaagttaaaggttaacaaatactcttcagcatgcacgtgttgcctctaatgatggcccattgagaccatagttaagaattgctggcagcttatcttcatctctatgggaaagctgctggtgagcacaaatgggcaagtctgttttggcactgaaattacatgttaaaaaaggatagaaagtaaaaaagaaaactaaaaatgataagaattggagaaggtgctttgttctatcctttaatagaaagtagccaaagatccctgtttcagggatttgaaattatgatttggttcagtaaataacgtaaaactgttctattcaaagggtttactttatgaaacttggggactgagtttgtagcatcataattgacacaaattcaggatgagaccaagagttgagcatgtcttaataactatttcagccactttcttctgcttttaaggcagaatggaggctcataaagaagaacagaggctcataaagaagaatggaatgaggaagctttctgctgtggctcacagtggggtcccagtttgaattgatggggtatatagcattctcagagtgcagtgattctctttgaattcagtttgaggaatgtgtatgtgaatatcgtgttataataagtcctattcccattcaatgaagtctgcctctcccaattatccccacaggtttcttatgaagaattaagaaataactgaaaaatcatgactcatctcattatttccacagggaatctcaggcattatacagtgtgtctgaacaagggttgctttgtgcccatctactttaaaccgtagacactttataaaatatgtaggttactccagtgatgaaagataaattctttggttttatttcctaacagggtacaagtatgaaggagtgaaatttgagaagggaaattgtgg

SEQ ID NO: 137956 - DNA, 2836 bp, Homo sapiens
tacagttcttccatggcaaatgttgctttcaagttgttactgaaattctcatctatacttgtcagttaactgtcttgatacagtgtggattttgtttactcctgactagcagaagttataactaaagcccgttaaagctagaatttctatctccctctcccagcacagatgtgaaccagcaaatttagatggagaacagatatgcttgagattggtgcatcaaactagttgaaaagatgatgcctaccactataggagttaatgcttctaaattattgcttatgttagggcttcagtatttcatttgaggtgactttccaaaacagcagacaaatttatattcaagtgtagatataaaaccatattttaagcaaattatttttgtattaccagccatttagatttaacatgtctttgttcctcgattgatatttagttgactacatttggttcccacatgaagggcctagaatgagcagtaggaagtattcaatgaggtcatagtcgcccctgatatttgtcttctatccctctctagatttcaagaaaattatacctatgggttttgaagtttgggtctttttagcaaatgaggcattatttgtagggttaatcacttgcaggactctgagcgtgggacattttttaagtattctaaatttaacacaagattaacagactattgaaaacaacattgtttttaagtaatatgaacttcagagtagtataaactttgtatattccttgctgaagaacacaccctagcacaataaaaagaacagtccaatcgtatatgcagtggttctcaaaacttgaatgtgcatcagaatcacctagagggccacagattgctgtggcctaacaagttcccacgagatgctaacattgttttggagaccatattttgatttaagacatttcttttataatagaagcatttaatgttataagttttcctataaatattgatttagctgtacctcacaaattttgatatagaatgtttcattttcatttatattaaaataattgctcatttttcatttcttctttgacccagggttatttagaaacatgtcatttaatttccaaatatgggattttccagatttctttctgttattgctttctaatttaatcccactgtggtgagagaatatacttcttattatttgaatccttttaaatttatggagacttgttttatggcccagaatatagtctcttctggtaaatcttccatgggtgcttgaaaactatgttttatcctgccatttttggatagagtgttctatgtcaattaggttaagttggttgatagtgttgttcaagtctactttactgattttctcttttttcatctgctccttctgaggcaactttattgactttctgtctacttattctatcagttgttgggagagatcgatgaaatctctgactaaaatttatatttgtttgtttctcctttcagttttatcagtttttgctttatgtattttgaagctttgttgttaggagtgtaaacttttaggattgttatgttctcttgataagctgactcattatcatgaaatattcccttttatccctgttattcttctgaaatctactttgcctgatgttaatgtaaatattctggctttcttttgaataatactaacatggcatatctttgttcatccttttactttttttttttttgagatggagtctcattcactctgtcacccatgctggagtgcaatggcgtgatcttggctcactgcaacctctgcctcctgggttcaagtgatgctcctgtctcagcctcccaagtagctgggactacagacgtatactgctatgcctggataatttgtatattcttagtggagacggggtttcaccacattggccaggctggactcgaactcctgacatcaagtgatctgcccgcctcaacttttcaaagtgctggcattacaggtgtgagccaccatgcctggcctcatccttttacttttaacttatgtgtggggtttttttgagacagggtctcagtccatcaccccggccggaatgcaatggcatgatcatagctcactgtaaccttgaactcctaggttaaagtgatcctcctgccccagcctcccaagtagccaggactacaggcatgcgtcactacacctggctaatttttaatttttctgtagagatggggtcttgctatgttgcccaggctgatcttgaactcttggcatcaagggatcctcccactttagcctcccaaagccatgagatcacatgtttgagccatcacacccagccctatttgtgtttttatagattttttaaattaaacatttcaaaattttatttctagagacagagtcttgcaatattgcccatgttggacttcaactcctatttcctgagtagctgggatgacaagcatgtgccaccacacctgaattgtttttatatttaatctgggtttcttataggtaacctagagttgggccttgctttatttttccaatttgacagtctctgccttctaatcaggatgtttagaccatttttatttaatgtgattattgatatgattggtttaaaatctaccatcttgctatttgccttctatttgttcattattcactttttcctctttttctaccttcttttgcattattatttattattccattttatccatttggattatattagatgcaatactttcttcttttagtggttcctttagggtttatagtatataactttaatttatcacagcccacttcaagcgtaagataagaacttcatgtacttctattcccccactcgagtctgt

SEQ ID NO: 137957 - DNA, 1187 bp, Homo sapiens
cagccaagagatagcgattgcaagagagcaccagctgtggtggtagtggtgagatttgtgcttgctttacattacccaggggaggtactttggtgtctcaggcaatggtgggaccatagagctcccaaaagtttctgcgttttgtgttaagctggtggaggagcaaaagcaggtgtgggctacatcagactggtctgtgctctgtcttccacatgctgggcaagaagtggccctcacagactatgtagacaaattggtacactgtgggtaaaagttccaagtatgcaaaacaatcttattagttagaacattccaagacctcaatttccagtagctggacaaggaccattcatgacaatagacccttctgaaaatgtacaagtttgagcaactcagacctactgagtcaactgtttcctgtacagtctaccttcctggccctaggctcaggctctcttaaaggaaaactactgtattttataatagatatattaataatattagcatgagaatgtccaacatttggaggagctggtgcaagatatagacttgaagaaacaattaattcaccgataaagccattgtatacatcttcatattttcttcatatttttgtagtaatttgattgcttcttcccttggtctaatgatacttgtgctttatgataaacttacctatagttatttagcatattaattagctggtggttaactagatctagttcctcaagccaataatttttcactgatatcagatcctgaggaggctttaattaaatttcacaatacatataattaccattatttgtattatatgacttattaacataaggtaatagaaccctaccagcaatgctaatgttataccatatcgtgcaatggcagtagtacagttctgtttcattccacaagtcagtaagagttattataccttacccaacataattggctcttgaccacttagcagatgttcttagggacagatgtcatcacaagggaccaggatgcctttatttccaggttccaagtaagatggcaactgatggctttaacacagactgggtggctttaacagcagaaatttattttctcatagttctggaggctagaagtccaatattaaggtgttgacaggcttagtgtcttctgagatctctctttggcttgcaggtacccaccttcttggt

SEQ ID NO: 137958 - DNA, 1032 bp, Homo sapiens
gtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcgggaaacagtaacatttttaacccactttccacttgattgtcatttcccctaaactttgaggccttctattttctacttacgcattttcaatctataaaaattatggttttgttgagggtaaaattaatttacctcttctatgtctaccttattagctgaataataaccaagaaacaacttcagacatgcatttctaccattgcttcactctgactatcttaacagaaccacctggtgcacctattactgaacattatttttaaatactttcatttgtcatgaacttataaggtttctactctttattcacctgtaagttttggacaacctcagttcagccaaagtaatcagaaaccagtttgcgtctatgtggctatttacaaggggtgtagacactacagtcccagtttctaaattgaaaactgtatataatatggagtctctctcgtgttgcacaatctacattttaattctacttcttcataataattgtcactgccataggctatcatctttgttaacactgttaacaagaaagatagggaagatagtagaaaaggagagaaagggagagtgcctgaactcatttgaggttgcctaaaacattattttggtaatgcactgcttttggaatctgaaaaaagctatggacactctccacataaaaatacaagcatgtgcaggcacacatacacaaacgcacatgtgcacacataattttacaatttcagagtgttttaaacgactctgaaattacataacttacttaacttagttgataatttctaccttacattgtgtcccatctttatagaatcatcaaatcaaataagtgcactcgaatgtgaccctgtgctaca

SEQ ID NO: 137959 - DNA, 1024 bp, Homo sapiens
ttactttcactctgctggcttaatcagtgaaggaacataaaaggaaagctggcagtgggtcttggtaatatatgaactatattagagtgccagaaaaggagacctcagaagttaagcataggttgccaatctgctacaattatttttcccaccaatctgctcaaaatgattgtatatagtattcttaaaaccatgtgtcttggtgcagaaatattgacaaatgctggccagctttatcttcctatatccttcattaaaagtatatgcatataattgttggttttttttcctaaattgtggctttgttaaacaatgttgacaaaccctaaagtttcagactactctaaggaagtttctatacatctaatttcataggggtatagtgatgtttgttcactcaggttgattggtatgcgtggtatgtagacttctctgtaacatctcaccttctgaacagccccttccatgtgttcggtatttctgtcttatgttcctacatgaatatgaattgggaaattagctgcaatggcttttagatagaaagctgaccagtctagtgacacttaatcacattcagtctctactcagcctcacacatcttttgcctttcactctgccattgtgatgaaaggaaaaagaaagaacttttcttatgtgcctaagggtgaagtgaactctggtttgctttttcttacactgaaggctatgtgtactattctccagatgcatgtcacctgaaaaaagatacatagaggggaacaacagacactgggacctatcagagggtgaagggtgggaggagggagagaaccagaaaaaataactaatgggtactaggcttaatacctgggtgatgaaataatctgtacaacgaactcccatgacacaagtttacctatataacaaacctacacatgtacctctgaatttaaaagttaaaataagtataaacaaaacacactaaaaaagaaacacagtagcccacttactcctaactcatacattaccctcagagaaatatttg

SEQ ID NO: 137960 - DNA, 1091 bp, Homo sapiens
gtttgcaaaatgaagatactcattgttaggatcctactgctgaagggtgctatgtcactttctagtgctcttatatgtctttaattataggactggaatgaaaagcttaaccatacagtatttctaagcaaaataatgtactccattcttttgtccatgctctcattgctgatttgttcttgcaggacttagagcactttgttaatgttcttccattcactccaacagcgtcctcagaaagagacagaataaaaaaattgttccccatggtacagctggaaaaattaaggggaaaagagattaagtggtccccaatggaacacagctgtcttatgcagggctcacagttaccatgttcagtacattgttaaagtaacttggcttcccaggactggaattatcatggagcagttagaattttgagagtaattacaacaggatcacattctgaaagagtcacattttgtcaaaaatctgaaaagtatgcaatttgtacaactcttactttctatgtgataagaatgcaatatgtgcctctttcccctactagccccatgtgacacatatttttcacactatgtggcatcaaccagtgccattacctcctgtggcaccatagagcccaatctcagggcagacattgccaaggtaaagaatgcactccatgtttataccaaattgcacaaagtatagacattgaggttaatggagatttaagcacaatcctagcaagtaagttttaagaatactgaatattatacattattgtaacatgaacctaaaattaatttaacagggcccaaattcataggaatgtaacagtcattgaaagcctattcttttcacctctcatcacacatatctacatacatgtatgcacatgtacacacacacacacacacacacacacacacatacacattttctccaaagcaggctgcctcttcagcaggagcaaatactttaatttaaaagaatgattatctgttttctccttttagaaaaagagtctaagaaacacagcatgtgaagaacattagatttatacattccagaatctctgctctcagagtagctaagagattcggtac

SEQ ID NO: 137961 - DNA, 1032 bp, Homo sapiens
agaacaggttttacattgttgttcaaattccaatttgaggaccttggtcacagtgtactgattcaccctcccaaattttagatacttgatatagcgatgattcaaagtctagcaaatatttaagttgctatttagaggaaaagcataattaaacaaaggcttcaggtttttagccctgattttcacactatagcagaattttgtatagatatgctgtacgtgttcacaaatgcacacgcacacaagcagcaaatgtagtttgattcccttcaacaccaaaaaggccctatatatgtgattaataatctttgtgggggaattaaagactctaaggaaattttctgaatttccttttacctgataagatgaatgaaaagatatattttacatttaggctttcatggattgggggaggggaaatgaagaaacaaaaaaaattggcttgaattaactgctaccaaattccaaattggatttcagtcagtaaattaaataacataaagtccagaaacatttacacagcaagtatttgatggaattctttcaaattttgaagctttcaatccaacacggtgacttattttgaagattacaatgatttccaacattgaactctgtaagcctcatgggaggcagagatggtgagtcctgggaatgaagagaagaaattcacagatgagctgaacaactgtaaatattcatgtggtaacacccacttgacaataatatgcaaccattaaaattacatttatgaagagtatagatcagcactgaaaaatgttaagtgaaaaaggcaggatataaaattatatatacaatgctatatttttgacccccaaaattacatttggaataagagactgaggaaatacactgaactattgaaagtggtggattcatgggtaatttgttttcatttctctaccttctacttgcattttccacattttctttagtaaatatataatttgatacttcaaaaatactatttttgaaatccacatggaaataacaagagctttgaaattgggc

SEQ ID NO: 137962 - DNA, 1047 bp, Homo sapiens
ctgtatctattttttaaaatgagaacacatggacacaggaaggggaacatcacactctggggcctgttgtggggtggggggaggggggagggatagcattgggagatatacctaatgctagatgacaagttagtgggtgcagcacaccagcatggcacatgtatacatatgtaactaacctgcacattgtgcacatgtaccctaaaacttaaagtataataataataaatttaaaaaaaaagtatttgcacccattttcttaaccaaatatgtatgtagcccctagttgctagggtggtagattagcacatttggcttagagaccagctacgaagtggaaaaccactaaaagcttcatgataacagagtctgaaaacaaagaacaaatgagaaacagtcagatgcagctagagtccaacagtgaaatcatttacttaatgggataaatgtgtgtctaaaaataatgtgcactaacatggtcccattccttacagtctttgaagtgattatggctcaccaattgacattttagctgaagtaaaactcagtttcttacactgcaggcttcagcatgaacactttcatttttgaaatgtttcaaaaccaaatcaatgtcattaccatctctttatgtgtcattactttcttcccagctctaaagatggtggtcattcggctgttgttgccgcttagattcaaataaagtgctgttaaatctgttcctatattctaaattcagcagtacaaaatacatactacccccgtggctgcttaattatttctgccaccatgtgtttcccctgtcttttaaaaagagagttctaattctttatatgcagtaacaagtttagtttgtgtgaagtgattaaactggtttttactaagcaatttagcaatacctaaaaatgagaggtctgtgctaccacagcaaaaagatataatagaaccaagtcacatacatggagaaatgtaaaatcatgactatgctgaaatttgtttctttattgctttcttcctcttttcttcaactctcctgccctgccttag

SEQ ID NO: 137963 - DNA, 1059 bp, Homo sapiens
ttttatttacatatgtgtacaaggtctggcaaaagtatagtgaaatatgttctttttaaatgtcatactagtggactccaggagatatcccttccccacaactccagtacaattactaagacatccatgatgaaggctgtccaaactgaacctgaatatcaaaagacagatgtggacagagctactagttatttagggattgcacaaaagcctatataacatgaatatctcacctcaaatggagacataaagccgtagagaaagaacatgaattcagtgaccagaatatagactataataaactgaagaaaaaaggagaagggtaaggcaataggaacctaaatagccaagaatatttaaattattaatcagtgcattgatccctagtaatatagaaaagatagtgtagaaaattatagtgatgtgtgttttccatttccctttcaacttgcttaatcagttcagatatttaataactttaagaataaggaattatataatagatgccataatcattaactcagggatacaagcaaaactttatgcagaagtaaaactttttcataaatttttctacaaatataaaatgcttcatcatctcttcctttgtccctttccacagcacaggattattattaagttacaataattttaaaatatattataaaatccacatactgagctactaccctgaatgtgaagaaaatctactatgtccaatcagcagggaaagtgtcggccttgatcttcactatagacctttcttggttcttaacacagtaggctactgtttaggaaccactttttacccttgtaacaaaataaacaatattacatttcacacattttgcctttagcccacctagtcagccaataatcaaatgtcacaatgccagccaggtgctatatgcttttttcattcttgaaagataatatttggatatgaattaatcatcagtaatgtgccaatattcacaagtaataccaagagtgaacataaccttgttctctttctattccctcattttttttctccacagtaggctagctcatgcctca

SEQ ID NO: 137964 - DNA, 1047 bp, Homo sapiens
tgcctgtttctgccaccataattcactgggttttatatttctgtaggggacaggggaggggtaacattttaaataaagaaaaaatataacaccaaaggtatggtagtgaattcctggagttacaaagctaatggtctcatattcattaactttagcaattgagcatagtaatgaaatacagcacaaacatttctccttttaacattacacaattcagttctgtttctagttggcttgatgtttgaaatattctagaatgttaaattcagcaattttccaaattttgtatatcagaccctgcgggccagtctgaaatcacctaactacaaaaagaacatgccacaactgtaccaaatgtagctgctaaaactgtaatacatttttagcaaccaggatccaggtttgcttggatgtgtcacgaaccagtccagagctattaggcaggccaggtgtttctgtgcctgtaaatgaaagaataaacaagtgagacatgaacttgttttatccagtttgttcttattaagggacttctatctctattgggcttttacacgacacataatgaagcagcagaactagcattattccattgcttagttcacttatgtatcagtgtgctctcaatcaagaggtcctgatgtcaaattagtttttctttttttttagggttaataactgcattggattttccaactacaaattcttccttcaattcttagcttactctgttctctactgcctgtacattgctacgacagtcttcagctatttcatcaaatactggagagtaagttaaaaatatcctgaagggtcccctagaacaaatgcacacccactccaacttgtgacattgttcaccctctatctttttacatttttaaatagctaatactgttgaagtaactggaagagaaggcactaaaaacaggttttccatattgaatactctgagatttcggaagctgttatttaaagattctagttaaacaagtttctgtcatacacgagaatcttgctaaggcctttgggtacctaatctcttgactc

SEQ ID NO: 137965 - DNA, 1021 bp, Homo sapiens
agggcacaccttaagagtggaaacagaaaatccctaaagctgccaaatatttctgtcttgacctgataccttccccataccttgaacgctactgcctgacttcttgaggagccaaaccatgagagaaactcagagtgcattaataaagggcttaagtaaccataggaaaacataagcctgtgccagaaatgctgccaccaggaaatttaaatctctgcaggacttatggtacttgattggctccatgctctgtgggctgatgccaagcccaagaaccaaggtaactaattcttagggaagtccaagtagacaccagaagaggaaaccaaaccctcatggtaaataaaaatcattaccagaatattgtttccttgacacagcctctgacagccatgagtggctctccacatctcttaaactgtgacaggtggcagtaacccaaaaaagctcagacaatggtcccaaaagtagcatccccttgggttttcatccattttctgagtgtgtcaagttcctactggacttaacttaaatctacaactagggaagagaatgagtgccatgagcaagagaacaagtaggaaggggtaaagcagggaaaagacatatggaggtacagctgagactaatgtcttgagcaaaaaatatttgtgttcccttctagtcctattcatgcttgaccacccttccaaattccaccccaatgaacttagagtctcaaaaaccgcataaaaaattccaggttcagacactgaagcaaggaaagggacagccacttatacaaaattataaagtaaactagcagcagtatcacagaagcctcctgacttccagagcaaagatctttttacaaacatcccagcaagtaatttcacttattcaagcttccatttcctcatctagaatgagggaataataatattacctaccccaagaatctgctgtaataaactaatgcctggaaaacacttagcgaagtccctgaccactgtaaaagctcaatctatattaaccattatta

SEQ ID NO: 137966 - DNA, 1073 bp, Homo sapiens
atctgccaaccttatcctggagtagcatgtatattggtgcactttccactagcagcaacactggcatacctgtctaatgctaaattcttgttatgtagcccaccatttgagaagaaaaatgcaatcacttgtcccagttgagcccattagattggtgatgacaagtgccttcaatcctagcacatccatattctctgccggaaaaagaagctgtgaggttatctactgagtcttttcacaaaaatgattatctttgtttattttcatcttacatgtcttgtattaatgagaatctgtgaaacttttcttgcatctttctctagcctgatcagcttgactcaaccctctcaatttttgccttcttatttatttatatccagagcaagtcctagtaggcaccaactactgtatcaaaaacaaagaggtcatttgacttataaatactttcttctccacccttttactacctgggaagtgtctcctattcagtttagcaatacgtgtatgtaaatagttttatatcacatcctggctttaaatcacttcaggtatgtttctttctcattttctgtcctttagctttgttattcaagacaagcctgatttatcagcctaatcagtcaaggtacagcttatctttgccttgccctccatcatcattaaactcgttctggaatttagctgcatgtctcctgattcacatgtggtgtagatttcactttgtattggaattaccttggaattttttttctgaaatatgtggctcatgaacttgaagtacttgagcatcttgcttttattctaaattcttcttttagtttgggcgatccatctcacaccttagctctgggcaagaactaatatgcatctctctacaacattccaaattactacccagtttgcaaaaagaataaaaaaggtgaactcagacaaaggttttctaagtgactcagcagcaatactttggggaggttttgttttggactgaatttttatattccatcaacatttatatgctaaaatctaattctcagtctaacggcatttgtaggtggagtctttgggaggtaaat

SEQ ID NO: 137967 - DNA, 1050 bp, Homo sapiens
tttcctcctttctaggtttccggggagttggtgtctgtggcacatgcgctttctctcccagcagagtcgtatggcaacgatgtgagtatgactcacccacagctcccacccactcagctagcctgggatctctgcaggacctgcctgccactaagttataacttcacgtcctgataatctactgcagaccctctccacttacaccagaaactgcaccttcgttcagttcgttttaatcttggtccacaaacgcaggactaacgcctgtggaagtggttccccaagttggccacgctttagaattactggggagcttttaaacatcccgctgcctagattgcagttcataccacctaaatcagaatgtctgggtaatgagagccaagaatcagtatttttaaagggtctctgagggattccattgtgcagcttatggtgtgtctggtttagaaaattactgagaaagtatatgaggtattttccaaaacaagacaagaggatgtgagaatagtaaaaacacccaaataagagtgtgatacatataatgagtgggtcaggccataagatccaaataatttagctgaaggagaaatccctaaggggccaaggcagtggaagacttgactgaggaaatggagctttacctgtatcctcaaagtgtaggtggacaaaggacatggattggcacgtgggaaaagtgcatggtctaaggcatggaggtaacaaatgcaaatggctttttctggagtcagtgaaatagctcggtctcgttggaatgggagattccagtggaacctccagtggggtgcttggtaagacttattataaccttgacctgtttcatgtgctaattcatttctaggtgttacagtatggggaattggctgtttggtaaacaaaaatgattatgacatgcttcagtcttaaaagtgaaaagtaattttcattttgattctttgttctcccaacaactcagtggaattgatgggtatattatttcagttttacaatgatttaactcaatcctgagaaggtgatttatctcctgct

SEQ ID NO: 137968 - DNA, 2440 bp, Homo sapiens
gcttatcactattctcagcaagttaaacagttgtgttttggagatcgtttttattaatgtaagttcttacccacagacaacagaggagcgaaggcaaatttgtttctacaatgagttctgctgctttgcccagcgttataatgctaactgacaaaagggcgtctggcccatacatagtaggcacttaataaatgtttgttgaatgaatgaacaatccacggagggcaatagccaggcagtactgtggttaagtaagccaactgccaaattggtggaagggattgtaataatatattatggccttaaactgtgtcatgatttcatctaggatgtagactgtcgacacttcctgaagagatcttctgccctgagaaccataaaggttttctggtggggatggggaagatagaagtatagtaaattacagactagcatctgtatgttgtcttactgtttcgcagctgatttcatcagttgacccacagttcctgaaactcaccaaagtagatgaccaaatttactctgagttccggaaaaattttgagacccttaggatagatgtgttggacccagaagaactcaagtcagaatcagccaaagaggtaaaaattctctttcttaaatattacttagcatttaaccaacaatttttgattgcgaatgtttttttacatttaagctctttttttgtttgagaaaaatatgtaaagaaccagaacttcttttctagttgtaatcaactaagttaggaaatgaatgtttttccagtttatggacttttcatgttgttgagtctatttttttctcctttttgtcttggacattttaaatctccacccatcagccctttcagaggaggatggatcagtttatttaggtagtatagccagaaggcttggatggggagtggcaaatagggtataggaaggtgttttgattctctggatttaagttcatgtgattacaggccatgggtaactggaaaacttttgtttttcattgcttatgtgattatcctatactttgataggaaactaacacatttacagttaggaaaaaaatgttttccttgagagtaaacccttggctaatgaagaatctaaagtttttgtttgtttgtttgttttgttttgttttttgttttttggttttttttttttgatacagggtctcactctgttgcccaggctggagtgcggtggtgccatctcagctcactgcaacctccgcctctcaagctcaaacagtcctcctgcttcagcctccctagtaggtgggactgcaggtgcatgctaccatgcccagctaatattttgtatttttggtagagacagggtttcaccatgttgaccaggctggtcttaaactcctgagctcaagcgatccgcccgcctcggtctttcaaagtgctgggattgcaggcgtgagccaccacacccagccaagaaactacacttttaactcctagcaggcagttagtgatctttgtctttggaaaactgtcactactgaatggacttctttattaaaatcatttgtgttttagtggggatagatgaccattttgggctgaactgaccaataacttcaaaacaaaacaattgacttaagaaataatattttaattctgcagtaaaggatttatatatttttcagagtaaaatattgttcatcttgggaaatggcagtctaaagacacaataggtagcacagaaacgcattgctagtttcactgtgaaaccaacaatcacctcaatcccagtctcactatgattattttccttactgggaaaatggaagtccctctcctggccttagtacgtcagcctcttgcatttgtcagctaaagcatcgtttttgcctttatagaagtggaggccattctgcttgaagtttaatgggattgttgaagacttcaactatggtactttgctgcgactagattgttctcagggctacactgaggaaaacaccatctttggtgagtttcttccctctggaattgtttctgtgtaaggagactgaacagtctggctttactgatgaatcagtgatgtgtatagttaggtcaccttatcttgtttcatctttaaagatcttgttgctatttttatgtaacttgaagatagttaagtattttcaatctcattaatatgagattggaattaaagatctctgaagtttatgactatactggaatggtttgcatgttatttcaattttgtcagtagatttccagcatatttagggaacaggccaggcacagtgtctcatgccttgtaataccagcactttgggaggctgacatgggaggatcacttgagctgaggattttgagaccagcctgggcaacatagggagaccccatctctacaaaaatgtttaaaaaattagccaggtatagtggtgagtgtttgtagttccagctattcaggagatt

SEQ ID NO: 137969 - DNA, 1051 bp, Homo sapiens
taaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatctatatctgtgactgactttaaaaaggtatttgacacttgaaatttttttcaaatatgtaatctcatcaccatgtcttatataagataatttactcctgtttcttactgcttctcactgtttcctgtagtgaagttctctaaacttgttaagttatacctggtgttgggattagaagtccttacataagaattgactcttaatctctgagtgactataactccctgatttctttgctatatatgacaaaatatttgataaatagcagcaacctgaacctgtcaaactagtgaatgcagcccagttcatattagaagagcaagagactggacatgcttcagtatttgcttttcttttggtagccagaatgttacctgaaagctagcaaaaaaaaaaaaaaaaaaaagggaaaaccagacagagtagctacccccttttttttttttttggagatggagtcttactctgactcccaggctggagtgtagtggcacaatcttggctcactgcaaccttggcctcctgggttcaagtgattctcctgcctcagcctcccaagtagctgggactacaggtgcgtgccaccatgcccagctaattttttgtatttttagtagagacggggattctgtgaagaaagtcaatggtagcttgatggggatagcattatatctataaattactttgggcagtatggccattttcactatattgatttttttctctccatgagcatggaatgtttttccatctgtt

SEQ ID NO: 137970 - DNA, 1661 bp, Homo sapiens
cctgcagctagcttggtatctgcccaaaaggtattccagttttgtgcttgaaaccaggtccctggtagcataggcaccatagggactctcctggtctgcaggttgcgaagaccatgtgaaaagcatagtatcttggcctgagtgtcctcagggcacagtccctcatggcttcccttggctaggggagggagttccccatccctttcccttcccaggtgaggcaacgccccaccttgcttcagtttgcccaccgtgggctgcacccactgtctaaccagtcccaatgagatgagctgggtacctcagttggaaatgcagaaatcacctgccttctgtgttgatctcgcttagagctgcagaccggagctgttcttatttggccatcttgccagccaccgtctaatggcttttcagagtacgtgcttcagttatctccacatgtatataaaagtttattcattacctcatagacacactgaacttgactgctgaaactggttagaagaaaccacaatgtttatagtacatacagtaaatacaaggctaaccacagcatgatgatgcaagaaaggatttaccaaagcagagaaggggaaaatgaggctttttttattccagtggacacagggaaaaaataaaattaaaactaattgacaagttatgccctaggcaagagctgaactgtagatgcatacatctagcagcaacaattgtgcacaaagcaaataggtttctccatgaattgtctttggcaaattcttagaaatatttaaaacatttgttacagtcttcgttttataaaaatgtcatttttaaaaggggtaagagaatgttaaatacttcatactagacagactttgttattaagaacttttactgtattaactttttctagttcatatcttattaaatattaacaaaagtgcattcatatacattgcctcaggctgaggaagaataaagattattggccacatacaattgtgcccctgatggccttttccaggtagctcaccagtaagaaaatgtgcttaatgacttctctctgattggttttagagaataagaaacatgcagttgaaagtcagagtactttaaagcaagaggcatctgtccaaagactggttgatgaaatctggggaaagggagggaaatacaaagaatactgtggctgccctataagggaacaggaattcaaggcagtatccaaagttagaggtaaaggagcgggcagaatggtgctctggtgcggtaagcaattcttaagatggacttaaggtaaccaccacttggcatacatgtcctttataattcccatctgtttcagtgtgggcatgacttgtgaatatgaagaaattttattcctgtgattaagttactgatcattttattttgagttaatcaaaggggagattatcctgagtggatcttgcctaatcaagtgagctcttagacaagtggccacagcagatgttctcatgttggccttgaggaagcaaacagccatgttgtgagaggagggtactttgtggtaaggacatgagagtggctttctaggacctgagattgttccctgtccgacagcaagaaaacaggatttcactcttaagttgcaagtaattgaattctgccaacaaccagtgagcttgtagaagacctca

SEQ ID NO: 137971 - DNA, 1989 bp, Homo sapiens
ctctttggtatttttgaatagttttagtagaattggtactagagcctgcatgtacatccggcaaaatttggctatgaatctgtttagtcctggtcttctttgttgaaaaattttactactgatttgatttaattgctcattattggtctgttcaggatttctgcttctagttttaattatctatttaaatttttgtgagtacatagtaggtgtatatatttgtgaagtaaattagatgttttggtacaggcacataatgcataataatcacattatagaaaatggagcatccattccctgaaatatatatcttttgtgttacaaacaatccaattataactctttttagttattctaaaatgtgcaattaaattattgtgttagactgttctcacatggttataaagaaatacctgagactgggtaatttataaagaaggttttgacagagctgacattgtctcctccacacgctgttacagcactttccagagccttctctctcctgtgcaaaatagcaactcttaaggaaaaactcattgtaccagttgcggaagaagaggcaacagtccaaaacaataagatcactgtagtgagtgttggacaagttggtatggcgtgtgctatcagcattctgggaaaatctctggctgatgaatttgcttttgtggatgttttggaagataagcttaaaggagaaatgatggatctgcagcatgggagcttatttctcaagaagcttaaaattgtggcagataaagattattctgtgactgccagttataagattgtagtggtaacttcaggagtccttcagcaagagggggagaggcgtctcaatttggtgcagaaaaaatgttaatgtcttcaaattcattattcctcaaattgtcaagcacacttctgattgcacataattgtggtttccaacctaggggacattcttacgtatgttacctggaaaataagtggattactcaaacaccatgtgattggaagtggatgtaatccggattctgctagatttcactgccttatggatgaaaaatttggcattcatcccagcagctgccatggaaggattttgggggaacatagtgactcaagtgtggctgtgtggattggcatgaatgtgacaggtttttctctccaggaattgaatccagaaataggaactgacaatgatagtgaaaattggaaagaagtgcataagatggtggttgaaaatgcctatgaagtcaacaagctaaatggatatacccactgggatattggattaagtgtggctgatctcattgaatccatgttgaaaaatctatccaggattcatctcgtgtcaacaatggtaaaggggatgtatggcatcgagaatgaagtcttcctgagccttccatatatcctcaatgcccggggattaaccagcgttatcaaccagaagctaaaggatgatgaggttgctcagttcaagaaaagtacagataccccgtgggacatccagaaggacctaaaagacctgtgactactgagctctaggctgtagaaatttaaaaactacaatgtgattaactctgagcctttagttttcatccatttactggatcccagtttgctttgatcttcttcaacgtgaatttgggctcacagaatcaaagactatgcttggtttaatgcttgcagtatgagttcttgaacaaataaaattaactattgtagtgtgtttctgaaaaaaaaaagggaaagcaagaaggtttaattggctcatgattctgcaggttgtacagaaagcatagcatcatctgcttctgaggaagcctcaggaagcttctcatcatggcagaaggcaaagggagagccgtaacatcacatggtgaaagcaggagcaagatactgagacgagaggtgctatacactttaaaatgactagctctcacaagaattcactcactattatgagagtaccaagggggaatactgctaaaccattcatga

SEQ ID NO: 137972 - DNA, 1325 bp, Homo sapiens
tcaggcctccacttaagcatgaacctcgagatgaataaaagaggttatagagatccttaaggaacaaagggggacccaaattggaagaactctgataaatgaacaattacagtacctgttagggttagtggacaatcttcagcaggcttctccttcagatgcagtcttaactttcaggcctgcctctaatttccacctgtggcagggttctgcccacatgaaaattcagtggtagatgaagtaggacttttccaacacaaagtagtttgagtgccagaaaatataaaatatcagaggtgcttcctggagccttggacccaatggactggtaaatatacacccataggtttttggtataagtggctagatctgttggacaggggtacgcaaatctccctaatcccagaaagtatccatgctttaaaggaacgccctcacgggatgactggctttggaggaggataataaattgggtaattacctgcttaactattaaaattggaatggacatcctcaggaagcaggtaacctcatggaaaaatgatttttgctattgatggacactgactgatagaattcagctaaccttgccctattggtattggtggtaaacatgccacagtactggataaggcaagacactgaagcatagaatccctcatagacaacttaactaaaaaaaggagtattaattcctactacctcacttgtcaagttttcatgatggcctgtgcttaaagtcactacatggtggtgggtaactgtagactatagagatttaacaaggctgtttcctttattagagtacttctaccagatattgtcaccttaatgaatgccattcaaaagaacacgtgtaaatagtttggagttatagacttgacttacatgttctatttagtaaaaatttcaaagagtcaaccacagcttctcttcaaatttgaaggtcaacagtacacattttcctaatttcttatggaaaactcaagtaacctaggaattgcgtgtaagctttgccaacagggcctaaatgcctgccccacacccctatcagaagcttagttttgccattatattaatggcaacttagtcgctgaacctggccaaaaatctgtctcacaggacatcacaaccctgaagaaatactgagaagacatgggcaattgttctgcaggatgtagaagactcttcccttgggtatccctgtccaacagatctagccacttataccaaaaacccatgggtgtacatttaccagtccattgggtccaaggctccagaaagcacctctgatattttatattttctggcactcaaactacttt

SEQ ID NO: 137973 - DNA, 1959 bp, Homo sapiens
ttaggccatttacattcaatgttagtattgagatgtgaagtactaatacattcatcgtgctgttggttgctgtataccttggggatttttaaattgtatttttataggtcctgtgagatttatgtgttaaagaggttctgttttaatttgtttccaggatttgtttcaagagttagagctccttttagcactacaagaactgcttattgactaatttcaattggtactttcaccatgtcctagatattgcaaggatcttagaacatttaaactacattttttccacatcttaatgctattgtatcttttatataaataagccaaagatgtcctctgtgttttgctcctgttgtgtacctcttcagagcaggtcaggttccattagctcaaaaccccattggtgaaaaaaatcaaagttttatatatccagttatttcaaatataactcaaataagcatatcttaaccatttagaggctagatgctttacaggccctatgaaactacaccaaacatctgctagtcataagtaagaaaaaccctagtgcaagaagactccaagccactgctgcccttcagagctctgtaacccagagatttcccatcacgtttctgagtaacatcacctagggacataagcagccttttaaattcccatcttccccaggacttcccttgccctttccccttctagttggttcccttcctcttccttcactgacagcctctagaacaggcttgtctaacctgtggcccatgggctgcctgcagcccaagatggctttgaatgaagcccaatacaaattcataaactttcttaaaacattatgagtttttttttagatcatcagctatcattaatgttagtgtattttatgtgtggcccaagacaattcttctgtttccaatgttgcccaaggaagtgaaaagattggacacccctgcttagaagatctcatggtataacaaacatttccttttacccctctaatctttgcacttcctgcataaaaacttggcaaagtttgcccaaataaagcttattatgtgctactaccatctcatgttcatttttttcttgatatctctaatattccctgaatctcactataagtgatggagagaaaaggggaggatttggtgatgaggttcagtcagtagaacaattatttggcaaaatgatcttggaaagacttaagtagttgggactgaaatttgagaattagttggatgtggtggctcatgcctgtagtcctcactacttgggaggctgaagcagaaggatcgcttgagcccaggagttggaagctgcaatgatccatgatcatgccactacataattcagcctgagcagcaaagtgacaccctgtttcaaaagaaaactcagaatgcctcaatattaatttgacatagcatcctcagtgctgtactgctttctatatttttatggtctttccattagcctagccaagttgtagcaccagaatatgtattaacccacactgttggaactgattttgggggatcagagacacgtagattcctgggaaggtcagcctgcctgtctgaatctcccactaggcaggcactggacattataaaacctgtaggcctaaataaaaaagggatggagtacacacctctgaataatgggctatgggtgaagaaactctctgcattagggatggtcatttgaggtactacaaggtgagaggagatccttattcctgtggacttctgtggtaggtaaacaagacaataagtctgagatgtaaggctgaggctagcctcctaagtgcaattgggaaaaaaaattttgtaaatagttagcttgcctctgctactgttgtacttggaccttctgtcccagatagcatcattctagtcctatatccccaagggatattgagcccccagtgctagggctcggccagctaaaatgttacttataataacaaaa

SEQ ID NO: 137974 - DNA, 1069 bp, Homo sapiens
agttggaatgattttctcatccttgtccttttggtaaatatctacccactcatctttttaaacatctcctcttttatgaagccttttctgcatctacaggtagaactgaccctgccatcccctgcattctttacaaacttctagaaaatttagctttactttttctctgactcccatttttacatcgggtgctccttgatgacaaagagattaactgtaacttcgggatagatgaccagtgtttgttgagtgaatgaataaagggatcagggttggatctgctcaaaagtgctagagtaatagagcaaaacagagcaggtaacacatcccttaacactcggtatctcaactgactttcacaaaagctctattaaatgagcaggtgattgtggagtgaaagaattaaacaaattttcaagagttttagtggctttcccactaaagcctgggtgactgggaaagtttgggctgggaatgttgggcttttcaagcgtgttcgaagctccctaattggtactaaatttcaggcattcagaccctctaggaaagagttctttctagctcacaacattaggggaggagttagacacataaatggagaaagtgatagaagagacatggtcagggatgggggttctacccttccagagacaatgcacattttctttgaaacagcttcgggaaaactgcaaatctcaatgatatttaccaattttgagaatctattaagtgcctggcactctgtgtagaagccctccaatcgtaccctaaatctgagaagtatttattattatttccatttttactccctaatgcatctactctaagctccttgcttcaccctaccaaagtttcccttctgctagtgctctcctttggtgcagaaccaccgcatccactttctcaggcccaggggaggggcggggcggggcgatttcgccttgccgcagagccagtctgcgcctgcgcggactgcggcagagggcggggtgtgagaagcagagtacagtgagactagcattcactgctggccagtgcctgcctttttcaccacctctaatttcagctt

SEQ ID NO: 137975 - DNA, 1106 bp, Homo sapiens
aatatgagtttgtatggggtcctagagcccgtttggaaacctctaagatgaaagccttgcgatatgtggccagaatccacagaaaggaaccacaggactggccacagcagtacagggaggcaatggaagatgaggccaatagagctgatgttgggcacaggcaaatctttgttcacaacttcaggtagaggaatgcatggcagtcagaggggccttgcaaggaggggcctttgagcctcagttctcatgtattggggggtgggggtgggtacatattgtatttggtatttgtgttccagttatatttatgtcttttcatatttagttctggtgtggtgtctggaaatgtttcaactgttttaatatattgtctgattgggtaaatgtgattgaccacttgctgtctctgttgtattttggtatgagttttgatagctctataaaatgttttggaaatctttccatcttgttgcattatctagaaaagaatatagcatatagctatagatataggcttttccttgaaagcttgaaaaaaattcgccagtaaaataatctagcttaaagtgataaactaacaaacaaatataacaacaactgaaaaggcactctaaattgtggctggcttccctttctgtctgctattgtatgaagaatactgatgtttacctgtatttgctttgctgtactaaaatgtaatgaaaaataaaagattaataaatgaaacataatgctaatacactgacttattcaactgctttcatacagtgagcacagtggtgtgccctagttatagaagtataaaagtttacaagatatagtacctgcccaagaattcagaggctggatagggtacagggggaggtcatttaaatcaccaatttattatggtgtactatgtgctacaatagaaaaatagagagtgctatggtagttaaaaagaggcacaactgaccaattcctggggtgttcagggtggtccttaaggaagctgttgggtatgtggggtggggacaagatggggtcttttttttttttttttttttgagacagagtctcgctctgttgcccaggctagagtgcagtggcatgatctcagctcactg

SEQ ID NO: 137976 - DNA, 3843 bp, Homo sapiens
tctgtggcatatattttacttagaaagcactgcagggttatgtggttttacaatatattagtacatttgagatattcctggtcagaattattcctactgcaagtgcctttccctttggtgtttgtcactaaaatgtttgtctgtcatcatgtgaaatattcaaaagaatgacaaagaaaggagtcttaacaaaaagtgttgtaactaatacttgagactaatcacagtacagaacacattactatggcaactaagctaaatgctgcttgcaatataatagtcaagacattaagagaatttagccctaaatgatcttactaactggtttctacagtaatggtcctgtgaatgccatcacattagtaatggtgttaacaataatgtgttttccttttggtatggtacccccttaacaaattgattttaagtcaaaacttgatacctcttttgagacaggtcatgcacttgtaatgactcccattttttctctatagttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgtagccttcccttagctatgttcattttccctccat

SEQ ID NO: 137977 - DNA, 1108 bp, Homo sapiens
aaatagcaccttcttcagttataaaatagttataataaattgctatcttactgtttgaaagtaagataaatatactcattaacttctattctagtgcattatagatgcacaattaaatatataatgcccaatattatgaaataaatgatttaaagctagaatcaattgtaaattaaataggaaagactgggtttttattataccaataatgacttaattgaatctgaaacacattataaaatgtgcttatggattcttctgcattattaaattattggtgtgataaaactcaaacttttttaatcttcctaacaagactctttgagcattgatatggtttactccactttattgatactgaattttgctgttctcttcaattatttaaagagttttaaaaccgactgctctaagttggcaaatggaaggattccctatactttaacactatgctgtctttctgccttatataacttatttcttgcattcttctaggacctcattaatcaaggaagagaaaaagttgtagaagcaacaaacagtgtgacagcagtgaggattcaacctcttgaggatataatttcagctgtagtaagctaattggcaattgtcttattccaacctccaatttgtaccctccaccccctactgccatttttttaaatttttaattgttccttcttataaattgatttgcaatagtaaaatactggtaaaatggatggataatgccaaaccgtaacccagcaattttacatagatgttggcacaagagagaaatgggtaaaatgtaagaattgagaaatcaaacatggaaatgtatgcattgtttatataaacattttaattaccagttgtacaaattaaatctaaattattgtttcattccagagatagccagcccaggtacagcagtgaacaacttagtaccctgttttgcatcatgtttttcttcagaaaagaataaaggaaaaggggggtttgaaaccttgggaaatcccgaatatcttaaaataccttaattatttttcctcaattgtacagtaataaggagtaaatagaaaatttttcttttagtggaaggagaacatgaatctctcagaggccc

SEQ ID NO: 137978 - DNA, 1324 bp, Homo sapiens
cccaatttttaagcttttaattttttaatcttaaaagactggcttaagataccatgatttctttaaactatatatactatgataataaattgaaaaatgtatatcaatttaaatttgacccatgggtctttacagtgtaatttaacatttacattcctgcagttggaatataagggctatatgtttcagttaaactctcctataactgtttagattaatttagattagttttttgttaatatagtggttggcagttgaaatgattgtgaaaataaagttgtttatgatgtataaataggagtagccttgatttctagcacaggcatccaatatagtcactaatttaagcagacttatgttagcatttatcaactcagaattaagcacaaaataaaatgcatataaaaaatgttaagttggtggaaagaccttgaaatctgaaaagtggtaattaaaaaacaatggaatgcctaaaccatactgtataaacatgaaagtcttacataagaggctggtgttacatgttttgctgctgttttttaggtaatctgtcatatatatcagaaatatatatagcaatcaggttttagtttctagtacagttgaccatagaactatggagatattatactgtccagaggggaaaaataattgtctcttatttcaacccctctaaacaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaaggtagttgatgcaaaatgtgtttttgtttttgttatgttagtgatttgaaagagcaatgaagaagaaaagggtcacatttgaaacaggtaataataatatagtgggttttaggaacacattccccaattacaagaatctctttatgggttggtttcagctacctttagtggtagagtaggaggagaagacagaagaaaacagtttacacttaaagagtagtaatcccatttctgcctagtatttgttgaattgagaaatgagtgggaagccatatatttagcatcactaacctcccatcagtaccctctctgtagtaacaaacatacaggagcttagtgtttggaggttgtagtaaatgtagctttgcatgtataccatgaaatctaaattttggctgaatatcagaacacaaaaatatttcattattagacattaatgccatttgctccagcagcaactttatttaagatcattctatgtctgttttaaacatc

SEQ ID NO: 137979 - DNA, 2115 bp, Homo sapiens
aagtgtctcctgaagatgaaaatggtaaaatagtgcgtggtattattttcaggcatagtataagcctgaactggcctttcacaagtttgtcttgagacttgtcattgtttcagtttttatgttttcttttattaaattaacatgcttgttttaaaaagttcaaaaagtacaaaagtacttttaggttcagtggctcatgcctgaaatcccagcactttgggaagccgaggcaggtggatcacttgaggtcaggagttcgagaccagcctggccagcttggtgaaactccatctctactaaaaatacagaaattagccatgcgtggtagcgagtacctgtagttccagctactcaggaggctgaggcaggagaatcgctggaacctgggaggtggaggttgcagtgagcactgtattccagcctgggcaatagtgagactctgtctctaaataaataaataaaagttaaaaagtgctaaaagtaagaaaatagacataagttccccctcccctggaatctttcattgaattacctttttttttctaagggaatagttctgggaagtagaggaactgtatctcaataaaacagacattctttgtggtgtgatagaatcatcactgcataggagccaggaaatttagtttccagtcccaggtagtccttagctgtataatcggaaaaagttactttgcctctttgggcctcaatttctactaattctatgatgacacagttggacttagaaattttaggatgctaaggactgacttaataaagctttcctggtatctcagacattttttaaaaggctgtatatgagtttgtgtatatgtgtatgtgcacatgcatttctggaaaggcttcccctccaaccattaaatatataattaatgttataaattgtgttgtttataattgagaaataaataccacacttgacaatgtctatttccaaagaattgggtatttttgtgcttttgtttattcctggtattttcatatcatcctgttacacacgtgagcagagaatgtgtgtatcatccatatttaatttacagtcatagctagactaagttattatccaatgttattgaaagaatcagtagcacagatagaaatgaattagttcctagtatacagttttcttggcctttctcttaaccagtttgctttcttagagaaatgaactgatctgactatgattaagatcatttattgctagacagaagtaaaattagagattatccatagaacattttaatcttgtaatttatttggtgtgttgtagaacacctgacttttctcattgtatttggtaaatgtgttaaaaatgttaagtcagtgttatctggttttattttatctcttgagtcatgtttggcatgtatgtgttgggggggtgggcataggagttacacatttaagaaagccctatcttttagtagaataaattaatgcagattggcctgtcttcctgcctgcctggtcagtaacagtggactttggagattgatctagtgatgataaacctattgtatgtggcataagccagagaagtcagcttcgatagcaagtttctacattggcgtgagagagaagcatttagttaacatttcaaagtaactaagcctgttagcatccatgtattctatcagtagactttattgagtcctgtcatttgtatggtcttttattgttttttgttttcaacaaaggaaatagcacacacatacatctcaaaatggattatacctgttgtaatctcagtattttgggagatcaaggtgggaggatcacttgaggccaggaatttgaaaccagcctgggaaacatactgagatcctatgtctacaaaatttttaaaattagccaggtacagtggtatgcacctgtagtcctagctactcgggaggctgaggcaggagaatcacttgagcccaggagttcaaggcagcagtgatctgtgatcaaaccactgcactccaacttgggtgacaacatgggaccctatcttaaaaaaaaaaaaaaaagaattataaagtctctattatggttgtatctattaagaatatcagttctgttaagaaaggaaataattgtttcaaatgttta

SEQ ID NO: 137980 - DNA, 2040 bp, Homo sapiens
taacatagcgagcccctgtctcttaaaaaacaaaagatgtggccaggcatggtggctcacacctgtaatcccagcactttgggaggctgaggtgggcggatcacttgaggtcaggggttcaagaccagcctggacaacatggtaaaaccctgtatctacaaaaatacaaaaaaaaaaaaacacaaaaaaattagccaggcatgtggtggtggcaggcgcctgtaatcccagctacttgggaggctgagccaagataattgcttgtacccaggaggcagaggttgcaatgagctgagattgcgccactgcactccagcctgggtgacagagtgagactctgtctcaaaaaaaaaagacataatttaaactgctaaatagctgctttcattcctatttcatatcttctgtttcctttttacattgtacctataattgagttagagaatgtaacaatgtttgtgaaatgttaactcaagattgtgtagaatgaaaattgagtttcgattcaggctatacttggaaagctgcaacctctagaatgtcactgcagtcatataaaatctagaatgatgactttctacctcacagtggcatgtggcatatgtaatagttgtaatggatatccaatttttaaaggtaaattgctaaatatagtatctagttctttaagtgttaaggagaaaacattcttatcaaaggaggcttttaccttccacctaagtcattttggcaggcctgccttttctttcatttaaagtgataagttctgtagttgtcactatcttattcataccaacaatttgggaatctggatatatttataaatgctctttggcaaaggttatgtgctcgtgaccaaaaaatctgatacaaggtgttatgtgaatttcattcaataagctctctagttacttatcaaattcactgcattttttccagcgtagtttgggaagaaagaaccttcaaatttgaaagtagaggctttttgaccaggaatattaaatttctttactaagaagctagatttatttaagcaataaaaggaatttttcatagctttttgagtgggtcatgtggcagttaagtattctggtgattttatttccagatattacaaaactcaaattgaaagtaatggcaagcaaaatatttttgaaacgtggcaaaccccctcccttacccccaggcaaagccttgattatttttttagatattttattttcaaggttgaatttcagaattaattagatgggaatttttgtcagcttgccaaatactttaaacttctaagtaaattaacttaaacttataatttatcattaattttgttttattaattgaactagtcgttttaaaagcttaaactaatttagattgtgagctagaatatagaccttgcttttccctgtgtataagctttttcacttatttaaggaaaaaaaagtttagacaaagaaaagtaaaggtacacatttggatgtaatttaaatctcattttgatgactgttggcttagtgattatagattctgctccactattgttttcaataatagtgttactctagcaactaatataaatgcatgcttttacaggataaaacaaaaacctttccaccagttgtgttgtgtattgggatgaaattttctttattaacttttataacttgctctggactttgcaaaactgttttttcccaaagaaataatctgaagatcctgttacaaatacttttttgtccccttaatttcattatttgtttcttatattgatagtatgctgctattaatttaaaaggggaagatttagaaacagtttgtatcagaaatcctatgtcttttttttctcttattcatgtcttacatagcactctggaggaaagaaagacttctgccttcctgcttatgaactacataaatgattttcaatttaaaaaaccagttaacttacttgcacggtcttttctttgttaaaatgaaaattatggaaagcatgcttatctttagtctttgaattttttggcataatcatataaagaagtg

SEQ ID NO: 137981 - DNA, 1161 bp, Homo sapiens
gaaattctagttgtctttatagtgttccttagtgatccatatatcattgaaaagcagtgttggaattagacttacttttcaagcagtaaaattgagatgaagattggttagtctgtcacagtgggtttgtggaaggaagagaattcgagctttaatttatatcttcagttagattcttaatttgctatcttagcttcattcaccactctactcattactttattatttttattttattttatttcatttcatttcatttcatttcatttcatttttgagacaaggtctcgttctattgcctaggctggtcctgaactcctggcatcatgtgatcctcctgccttggcctcccaaagtgttaggattacaggcatgagccactatgcctgtccactttattattttaaatcccctcattggattcttactgttgctgcttttcccttttggaaatataatagccttgacgtcctgtgaacctattttttaataagttgatttaagggcctcctgaatcatctctaccaagtatctgtgcatctttttagttgttcaggataatgtttctcagccattttgaaactgtagcatgatctagacttataagtagtttaacacaagtttctagcaataccgatttgttaacttattcttaatggcttgtgtttaaaatgttaaattaatagctaacctctgttaacgtttatgtaaatgttaaattgatagctaacctgttaacatttatgtaaattatgttagagaaagtaccttttctggtaataaacttattaattatacagatatcagagatgaaaattttggtcaaggtcatgttttattttattttgagacagtctcactctgtcacccaggatggagtgcagtgctgcaatctcagttcactgcaacctccgcctctggggttcaagtgattctcgtgcctcagccacctgagtagctgggattacaggcatgcgccaccacgcctggctaatttttgtatttttcatagagatgggctttctccatgttggccaggctggtctcgaactcctggcctcaagtgatcgacccacctcggtctcctaaagtgctgggattacaggcatgagtcaccacctgcagccaaggttatattttataatatgcttaagtgggtgt

SEQ ID NO: 137982 - DNA, 1197 bp, Homo sapiens
ccagccaaaaaattttatcttaaataatgaagcttagttattcattcattgatttaaactttttggggtgcctatgatatgccaattgtactggtctctaaggatacactcataaataagtctaggattctgttcccaagaagctatagtcttaaaagcttaccttaagcaagtaatatagtaagagttacagatcctataatagaaatctgtgcaggtgccaaggaaggaatattcatttctttcttggaaagtttgggatggatattgatgtgcttgaacagatgttgaaagtagaactgggtaactgtttgcattgctaagacggcagaagagcaaaaggcctttcaagatggggaatagaaaaaaagaagcacatgcataacatggcatgataagtttgaagaacctcaagtagttaaaaataaataagagtataaggagatactggtagagtaagggtgagtgtgggaagaggtaaaagtaaagactggaaaggtaggtgggaatcaaatcatagaaattagtttgtaagttgtgttataggttgtggtatctatttaacaattttaagcaagagactaccgtcacattttcattttagaaaaaaatcattttatgtatcagtgtggaggatggatcagagaaaagaaaatggatattaagatacttgttaggatgctactaaaatgattcaggtgggagaggtaatacaggcctgatatgagatgttagcagtggagacagagaagtactgggcataatatagatactcagtaattattaatgttcccttgatttataattagaatttcatgtaagatttccactagtttaatagaatttgaaaactggtcatctgaaatgggtacgttttgatattcatggcgagggatttcttggtacgtttggatattcatggtgatggattttttggtatttgaagctgcttttattcaaggtattttgaagttggttcctgttattatagtacaattgcaaacaccttccttcttgtccatgatttttaagatgaaagactgctaaaaatgatacattttcatcctttcaattgctgttatctaagtaataattaaattccatgcttttatgaggtttttttgtcttttggtagtcccgaaagcacttctttttaacttacttgatatgtgattactgtatctctttctgcttcat

SEQ ID NO: 137983 - DNA, 2303 bp, Homo sapiens
gtctgtcttcttgcttctgttttatctacctcagtaccttgcatctgtctaacgcctctccttacattctttatgctgtattataaatgttgagtcacccctacatattcacctacttttgcattttccttcattttgatgtacttagtgcccctagctgtacccaatacaatatagactttcaggttacatataaattctctaaatttattcagaaatctgtagataaaaccttgactacattgtaaatatttgatttttcatttcatctttattcttaaatcagacgattttattttccaacaataggattcttcctgggcatatgtattatcatcctgactccttagataatatattattttcttcagtaagtaagaaatgaattctctgaactcttgatagttaaaaaaaaactaagtatcaaaaagtcatattgtaattaaaatatttgtaaagtactaattactgaagcatttattctatattttcattttcagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcaggtaggtttataattctctttttcatattgaaagtttatgtgaaactgataatattttagagatatggaacatatgtgtattacagagagggaaacaaagttggaaataccatttctgtacataaagcagcagaagtcagttttggcttttcttgattttctgttttgtagtgtatccatttctgtgatgtcatctttctcaggttgagattgttttgcatgaacacatttagcagatgctacccccagcagatgcaacccctctcagcctgcctccaaatctgggcttcttaaccagaaactgggttttttttggtagatccttgcttatttgatcttctttagtacataagttgattgacaactttatgtaaactctttcctgttatttgtttatttattcaattttcttttatttttttctttcctgttaagtttaaaacttctgtacattctcatttataatttgtattatatttaatatacatttaatataatgtatacatttaattaatgtagtttatatgtaatggatatggtattttatatttgttttctgtcttgaaattatagaaaataaaacgatataaaggcattttatggtgtttgttgatagcttattatattacattgaaaaggaatcaaactgctctcttgcattctaacttcaatatttacctaaatgttttttgtgtctgtccctttatttctgtttactctggtatctgcctgctgtcctcctcctacagagtacagaaataaataaagcaacacttgaatgcattttggtcagttaatatagaataattatcagtaatgtaattttatttattatggtaaactatgctaaacagatgaaatctttcatgaattaagcaaaattgctgatgagtttttctttatggcaatatactaccataaagttttaccatttcatattaaccagtaaccgtatttatccttgattaagtttcatgcttacaaaattttatttttttgtatattcttccttctttttacaaagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggtaaacatatttagattattggcttaacaaaccaacgtggactaaggaaattttactactgatatcaaatttagtcatctgattaaggctatatttcagaatttttcaaggataataaaatgatatttaatgaattttgtctagaaaattataaatgatagggtgcttgatctgttctccatatagcaccacaaaaagatagtatattctgaaacacatattttatgccacatataatatatctaattagcatattttctaatatactttacacttcaacttttataagaagtagcagacaaattttccaattagaaaaggggaaattacttcgaatttattcatatggtgaatttcgggttgcaggaaaccagttaattttataaacgtgtattatttgctgactt

SEQ ID NO: 137984 - DNA, 1575 bp, Homo sapiens
cactgaaatttgcagctaccccatagaataatttttggcacatagtaggcattcagtaaagatttgttcagtgaatgaataaaggcattctttatctctcatttttatttgatcattatcaagttgttgataaggagaaaaacgtggccatttacagatataacttaaaacatgcctcatgagcgaaatgtaagtttaatcatattcttttgacagttttaaggattctaatcaaggaaacccttttaagaaattctcatgtagatgaaataggctttaaaaatacctgtgctcatcactatctatttgaatgaaatctgtggttaatttatttataatgtaatgactccttgattaagaaaagtatataatgtattttgctatacaaatagaatatatataacccacttttaaatgatgagcaaggtggaaaatctgttcttaccagtaagcagagcgatatatcaaattccttttgtgttcttttgttaaattttcaggtgaggggaagtggcttcgaaacattgactattaccgtttagatggttccactactgcacagtcaaggaagaagtgggctgaagaatttaatgatgaaactaatgtgaggtaggaaaaattttctgtatatgtagaaacattaaaataattaattttaaaatttacataaagttcactatttttattgtgtatttgaatgtttttagcaaatgcaaggtacagtcaggttgcaaaacagtgtcatcactccctaaccactgaattcacttatggaatcatataatttgtagccttttgagtctcacttctttcacttagtgagatttatttgagaatcatttacattgttgcatataccaataatttttaaaaattgttgtatagtcttccattatagggctatatcacagtttgttcagctacttccacttgagggacatttgagttgtttccaggttttggaattaaaatcaaagctgctctaagctttcatgttcaagtttttgtgtgaacataagtatttacttaaatgaaacaaaagcctaggattgtgattgctgggtcatatagtaagtgtacatttatctttgtaagaaactatcaagcagttttccaaagtgactgtacaatttttcattcccacccgcagttgtatgagagttccagtttccttacattcttgtctgtacatggtattgtcattttttaaaaaaattattttactcattctaatgtatgtgtagtggcatctcttgtgattttaatttgctattccctaatgataaattatgttgagcatcttttcatgtgcttattgaccattttaatatcattaactgtagatacaaggcaatttgtgtgtgtattgatattgttttaagctgttagtaattgacaaaatcaagctacatttggaaagaaaaagttttatatatagtcatatgttgcttaacaaccagtatacattctgagaaatgcatcattaggcaattttgtcactatgcaaatatcatagagtgtactgtacatcagtaggctttctgtgatatagcttattgctcctaggctgcaaaa

SEQ ID NO: 137985 - DNA, 1312 bp, Homo sapiens
aagaccattgtgtaggtttttttttttttttttttgagacagagtctcgctctgtcacccaagctggagtgcagtggtgcgatctccactcactgcaagctccgcctcctgggttcacgccattctcctacctcagcctcccgagtagctgggactacgggcgcccaccacagtgcccagcttattttttttgtatttttagtagagacggaatttcaccgtgttagccaggatggtctcgatctcctgacctcgtgatccacccgtctcggtctcccaaaatgctgggattacaggcgtgagccactgcgcccggctaccaagaccattggttaaaagactatccttttaccattgaaatgcctgggccctacaattaattatcctatgtggctctctatctggactctattctgttctattgatctgtgcctgtccctttactacactgtcttggttactgtaactttgtaagtaatgaaatcatgaagagtcagccctccaactttgtttttctttttcagaattgtcttccctcctctgaggtggcattctcatatacattttacaatcaccttgtaatttctacaaaaaaatcctgctgggatttttgttacaattgtgttaaatttgtagatcgatttaggaagaagtgatatctttactaggaatcttctaatccataaacactaatctgtttttttagccttgttttcagccagtccctcatatctctggacttgattgaagattttcttgaattagctagtagggagaagacagaagataaagataaaccccttatttataaaggtgagctacaaatatttctgtgtcgtaattttaaaaatactgatttaaacataccatacaaacattttagcaacaaaagaaacaaaactacccagtctcacaactctatcatatcaaaatttttttgcaatgtctatttgtccttatccatatatatgtatagtctttttcaaaataaaattgtattgtttatatttgaggtttacaacatggtgttatgggatacatatagatagtaaaatggctactgtagtgaagcagatgaacatatctatcatctcacatagttttttttggtgacaagagcagctaatatcaacttaagaaaaattcctaatacagcagtctttgttgttgaaattgttggataaattaaaactttttggtttctaaagcagttttattgagagataattcacatcctgtacaattcacccatttaaagtgtagaactcaatggttttaatatattcacagagatgtacaaacatcactagag

SEQ ID NO: 137986 - DNA, 1977 bp, Homo sapiens
catgattagattctcaagaacttctgataatagaagtatttgataaagactataagtatgtctaaaatgatatttttaaaattcctaatcataactttatgccagaaaatttaaaacttaaaatacacaatatttaagaaaaatatactcagcaatgagcattcgttgcagttatttcatattagccaaaaacaagaaacaatctagatgtctatgaggagaactaataaatgatagtgtattcatgcagtggaatactacatggtagttagaatgattgaacgggagctccatgtcaagcatgagtaaatctcgctttgagtgaaaaagtaatttgtaggattttacaaacagtatagccatttgtacagtttagtgatacacatgcagtaaaaaacataaaacactgcaaaaaatggtaaatatataatttaggggtttagttacctattggaaaggaaggaaggaaagagaatgggatcatgtaggatcatatattaggcttcagcttcatccgaagttttaacagtgttaaaatttgatgaagatggaatgtggaagcacatttgtttcttatatcttacatacttttctgagcatttaaatttttgtaacaaaaatatattttaaaatactttgcattaaaaagcaattgagaaagtgtataaacatgctaaacctgcatatttcttattttgaatcaaactatgtttaaatcttttaataaattattttatgctactttctccttccacctttcatagtcaaagtttgtggggaaaatatataagaacgaaatcatttaatatgatatgctgattctggggtcaattcttgttggcggtttccagatcctagtagcacagtgaaatgttttctacccccaaggtcttttctctcgtggtaactgagcctttccatctctgttgattcctgtctcatggagtatgtttgggggcattttactctcttagggcctggtgggaaggggatggtttctcttctctttgggtctctgtctttctgagctccactcctaccccgagggtttgtctcttacacttgcactctctcagagtcaatctcttgcttgttctcttatttggcatctccttcctttctctttttctatctagagctcactcttctgggatagtctctgtccttctgtgctgtatgtgcgtgtgcctgcctttctcttttttccctcccctctcccaagtccccatcagtttctttcttactctccccatgggtaggtctttttctgtctctcttgctctctttccatttcttttctaatttacctacttatgttccatttgtcttatttaggtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtgtaagtgctttaccatatttattatataaattaaccttttgattatgtttttattgcttaaacaatgtatttgaacaaatctgttgcttttccttccttcctaaagatgtgatttatttggtcattgtagtgctaggccaatacaagcaactatcttttttgtaagccactagttctgattgcatattcaggttatttcttcagtgtaaatttctgcttctacctgttgcaacttgaacttatttccttgggtagagctcttagttgaaatttgtgtttctccatcttcaaaatcatttttcggtttatgtagtgtgacttctaccgtgttgctttactgagatttccccctgtaaagtcactagtgaccttctaatcctcaaatctagtggacatctctcaggctttattttattttacctgcttgattattctttcttcttcttcttcttttttttttttttttcattatgagacagggtcttgct

SEQ ID NO: 137987 - DNA, 1509 bp, Homo sapiens
ttgtgagtattttctctcattctgtaagttgtctgtttactctgttgatagttttttttttgttattttgtgtttttgtttttttgtttgtttgtttgttttttgtttttgctgtgcagaagctctttagtttaattaggtcccagttgtcaatttttgtttctgttgcaattgtttttgaggaattagtcataaattctttctgactcggtgatttctttataaacatttctctcttcagtacctccatggaatagacagatggcagtctaacagtagactctgacttctcttaagaaatcaggggaatagtaaaaattaaactacaaaatttctcttctcattcttctcttctgttaccccataaaacagtttactatcaatgttcatcttctggatagatataaagaatatttttatcagaataataaattattatagtgtaatttaaggcaatgagaagttcctgtatctccttccctgctgctgctgccccaatctgccttttccacataaattcctcagtctctcatctcataattaaaaatatataaagtttacatgttcctggaaattattttcttaaaatactcttgttgaattttttctcataacttatggctaacaggagcagaagagtagaccagtcagtgtgcatcatcctgtgctataaatgggttacgtaagagtatactgagattttttttttaaagtgtactgagatattgatcctttgtcacttgggaatacaattagaatctgaggcagctggtttgcctccgtaaatgagtagtctcttctctttttcctggtatgctatataagcattaacgttttttacatatgccataatgtgaatgggttggaaagcactgggggcagaatgtaggaggctacatgttgtgagcccaaaaacacacagggaaggccatcagttccaaaagacaaattttgaccacttgtctaggatttttgtttcattttagttgtgtgcagtcaaatataagtcatttgtatatggatatattttatatatttttgtagcttatatacgtgtatagtatattagaagcattctccagaactaatagataataaaatttatttttttctttgcatctaaattaactccatataaaatggagtatatcataatgtatggacatacgtagctggtattgtataactttaaaaaaaatgactttcttacagtaaatataagaaaatctgaataggaagtattaaggggctagtctgcctccttagcgcagtaggcagcacatcggtctcataatctgaaggaagtattaaagggttaacaatgttgtacctggaatttgaaatggatattaaataattaattacctataattgagctacaatatgatttttgccacatattttattttcacgtcaaagagttactgtttgctttaatccttttgtagtagctgtctcgtttttctgagaagcagcatcttgaatgagtcatttaagtttagcttacat

SEQ ID NO: 137988 - DNA, 2724 bp, Homo sapiens
tcaaactcctgggctcaagtgattctcccacttcagcctcccaagtatctagggtatctagggctataggtgtgtgccatcatacctggctaatgtttttgtttttcttggtggagacagagtctcgctgtgttgtccaggcctgtcttgaactcctggcctcaagcggtcctcctgcctcggcctcccaaagtgctgtgattacaggtgtgagctactgtcacttgcctagaagtaatttttttgagtgagcatagttggcgagagtcagtaaaggactatctgcatggagcaaagtttatttataacaggagtttgtaatctagggtccatggatagaatttaggggattatatgtacctggataagaaaaaaattatatattgatttcccttaacctctagctaaagcagcagcatttttcccagtgatgaatagaggcaacaatctatagtagtgttagtgataaccatgactttgttaccaatagaaatcagaaatatttttacatgttgttcctgatacctcaaaatcatttatgtttatcaatacttcagaattttaggtatttattaaacctgtgcatattttgttacttaatgcattaattttaaaaagcacatatttctgtagtacaaattctttaatattttgataatttctatatgatgggtttcttttgtaatcctatttgttttatgtgtttcaaaacgatattccaagagaatttataagcttctctacactgccaaaagtgtttatgtcacaagtaagattaaaactcctaatctagaaacttggttgatatagacaatttttgtgtctttaaccatatttcttttgatcaggtgtgggcaataatagtgaaggtggaagaggaaaggcaggtgcaaagcttttccaagattttcagatgttaagtagaatatggactcatccttggtgtttgcagctagactacattagcaaagaaaataaggtaagtcaggtaacttagtttaaaagcatctattggaagcagaataaacttagacaaaaaattgacctacagactgtatattcaaattttctattgctttgttctattctatgtcttatttctaatttctatatgtcttgcatgtattatgattataggagtgttaaatgttattttattgagcccattttaaaaaactttttattttgaaataattttatacttatagaaaagttgcaaaaatagttctgagaattcccctatacctttgacccagtttcttctaatatcagcatgttgcattagtatagtaaagttatcaaaactaagaaattaactttggtacaatactattaactaaatggcagactttatttggatttcttcaatgtttttacttatgtcttttttgttttccatgatccaatctaggacctcccattgcatttagtaagcatatctgtcctgtcttctttgtctactaaaatctgtaatagttcctcagtccttcctcagctcgtgccaattaacttattcttaaatgaacatcaatataatttccagtgtaagttgagatattctattaaaatagtggtcatttttttttctctagggttattttgatgaagacagtatggatgaatttatagcctcagattctgatgaaacctccatgagtttaagctccgatgattatacaaagtaaatcgaatactttttcgtgccatcctgtattgacaaagttaaaacccctacttgctgattgacctcttataattgacgtttacatctttcctatgcttttctaacaatctgaatgtgtttttttgtttgtttgtttgtttgtttttagaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtgagtctaatgaatgttgcctttatcatggaacagtaatttggaaaatgtcatgtcgttagtccttttttcagtcacttacctgactaattgactcaaaggaatctttcctcaattgatgagtctaatcaagtactcataattacagtaaatatctgatgaatctttaattataagcaagctactctgtgctctctggtatttgggggaaaggtaaaaagaaaaactaatgtttatttacttgtatatacctaaactctattattttcactacatgtgttagctaactgaattcttgagcaggcttgcaatgtagttgatagttttaaaaatgagtaggagaactggtattcagacctaaaaatgtctaatctcaaagccaccatgatattttcacttaactgtatgggaataaatggaaacatttcagataatcaagtgtgattgtagttaatttttagtcagtaatatacagtaaaactaattttaatcatttagtgtttttcctttgtgattcttcataatctgcaattatctactttaggtttcctgtgtattatgtacagtttctatcacctcttttgttttctttctgtctctcttgtgcatgaaagtgaagtcttagattgaactctgcagtggtttaagttgtctttacctatatgtaagttgaaggattagtgttgagacactgtatcctactagtgcagcctgtatgccta

SEQ ID NO: 137989 - DNA, 1025 bp, Homo sapiens
tcacactacctactacatcccctccataccttttgttatttttttttctgtacagagaagactattttgaaaacttaaattgctcacttggtaatgtgattgcttcaatttaaaacctacctggtgtgttgcagtgtctttttaccagtgtaccatattgtatagtcatatgaaatacattgtgtagataattgtgggtttagaaagggtaaatatatttaagaaaatgttttcttatatgtttagtgcctatttatttatgtgtatatttcagttataagcaatgagaacttgtagttcattcctgttaaatatttagattaattttcattctctttcttgttaattacagaggaaagattatacagcattaacaaaattcttgcctccaaaacacgaatatgtgttagctgtgagaatgacttctattcagtgcaagctctatcagtactacttagatcacttaacaggtaaacaatacaccttgttgatttcatcttctctataaagacattctttttccaaagaagattatttcagtcatcttactatgtctgttgttctttttcagttttgcatttgaataaaatgggtatgcttaaaagcataaaatatttctaattaaaacactgatgctgtcaaaattaaaatcaagaagcaaattgatgaaaaagatatacagcacatatgaataatgcccttaatttgtaaagagcttttatttcagaaaaattatgaatgtgaataaatccataaaagaagatatacaaaattccagagtatttttttaaaaagtatttacccacattaataataaaaggtgtataagttaaattcatgagtttgtttctcagttatttaattaacaaaggttgaaggcaaaagtaaaatagaaggcaaggcatgtagtatgcctaaaatacaccaaaatgctaacagaagttgttttctgggtgcttttgttatgaagaccttctagtttatttcttgtatttttctatgctttaaaataatacaatgaatag

SEQ ID NO: 137990 - DNA, 1825 bp, Homo sapiens
cctttagtgtatttatggtaactttttgctattttattatttgtaatactagtcatttcactttagcctatactttatgtttgtttttatctgttccagttttcctcttttctattctgttaccctatttatagaaatgctgtttcatattgtggtcctatatagtatgggacaagtgatggctctgttaatttttacaaaatgggttagtcttacaaaatacattagtaattaattttttttttttactatttgtgtagccccaactgaatactgaataacagttgttattatttgatctctcaaatattatttggttattctggaaatgaatcagttaatataaattaacttgcttagtagcttattacctcctatttattgttttgacttagtatctcctttcttcacaagatagcctcactgaccataaaatcatggttagattaatggaccacttgttttatacttcatatctcttataaagaataatagtgagtttgaataaactgtccttaggtatttttaaaaaacgttcatgtctagtatttagggatggtttttacttcaattttctctctcgttttggtaattcacttgtagatcagacttataaccatgtttattctatacttagcttgatattctttctttatagcttaattctaatgcatgtgtttttgacatgagcatttcattggggaatttttctaagtctttttaacgattgttaatgttgttaatgaataatgtcttctctcttagatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcaggtacaaatatgttccatagtaataaaatattcttacttttttatataacaatcccaacatattttctgagcttaaagtttaataattttgtgttttctttcccgctctttcagtagatagttttacagttatatctccttgcgttgtcttaaaaaatttctgctgcattcaacttttaaaaaagaagttccgctgagtttaaaacatagttgattcatttgccaggtgtaaagcctcatatcttattatgttaatgtttagatttttcatccttaagatagggagttccttaagaggaacatagctactatgatgaagttcctatgctcaccctaattctgtagtacagtattataaatctcacttttttgaaatggttataggagaggccagtatgaattaagagaggagccacttttaaagtaatcctggagaaacagttttgttactttcaagtatatataataacctgaacagactagtggtgtcgtttacatacagattttcagtgaatctatattaatgaatggataagtgtctagagactgagctggcagttaatagatctcaagatacgcactttctctgtagatgttaggtactgatgatagcctcaaagatgttttaacaaatgagacaggctattcttttggttggatatacagtttgccctccatatctgcaggttctgcatccatggattcaacctaccatggatcaaaaatatttttttaaaaaatagataaaatggacagaggctaggtacagtggtgcacacctgtaattccagcactttaagaggccaaggtgggaggatcacttgagcccaggagttcaaggctgcagtgagctaaaatcatgccactacactccaggctgggtga

SEQ ID NO: 137991 - DNA, 1100 bp, Homo sapiens
aagtattatatggtctgttgtgacatatattattcttaaagtgtaacttttgaaatttgtcttttcatgtatatatacattgctcttagtctttgctgatagtttaagttgatatactaatgctgaaatagctttaaagacttttcaattttaaaagacatttttaaaaataggctatgtctgttgggggaactttttccctcttgttgtttttatttttgcttatttttgtaaactcagaggaccctgactaccatttatagtggtatttcaatgctctaccatttggatataattaatatagttagtgctgtattaaccaaatacgggagcagataaaatatgtttatacttacaacgatgtcattttatcttcctgtaagatcagcactttaaagggattaactttatttacttaaatggatcacattttcagttttattatatattaattgtgttatttttctgtttatttttgtaggccctgattttgttgtttgtgatgaaggccatattctaaaaaatgaagcatctgctgtttctaaagctatgaattctatacgatcaaggaggaggattattttaacaggaacaccacttcaaaataacctaattgagtgtgagttaatatctctgattatgcagtagaatattggtatttcctcagatatatttttgtaacgttaccatttacctttcttctacttattctagtatagtcctagaccatgatctacataggttcatcttagtctgctgtgaaagaataacatacttttcaaatgagatgctttataaatgagtggtaaaatacagttaagagatacgctattgtgaatgttcatatataaatatggaatgtgaattattgcaagagtatcagaagtcttaatgattgctttagaaagtacataagcatatgtgattactccagataattttaaggggatattccagttttggggcatgtactgtcaagaaatcagaaagaaatgggaactgtgaacattttagtaaagtggagatgggagaaggagaggtttgctgaatccatggcaggacagtttgctgaggctaaaggtagttgatgtgaacctagg

SEQ ID NO: 137992 - DNA, 1071 bp, Homo sapiens
ctctacttttattttcttttccagagtatatataagtattagagatagttcctctgccatagctgggtaaccatctgcaacaagaatattctaatatccatcatgtataacatggaatatattaaaactgttgttaagttttaaggtttagtgatagtatctagatataattttctttgccacctaagtctaaagtgtcaggatctgttcagtacttctaaatttattagaagggatctgttcagtataacacttaattttccagtacatgttttccattttatgcccaatttatcttctctgatttggaacaaattagtgatagtgaagaatcatataaatggcagcagagtatgtgaagactgaagtttgggtgtaatgttaaagaaaagtctaaattgaagttcaagatggaaacaaaatgtcagaaccagacagttttgggtatgagattcttaaggatgagctgaggttgtaaacttataaggtaggctattagatcagaagcctggaaaattgggagtatgtattaggattggaaacagtgtttagagctgaccagagttaagatagtagtgttcatctttcaacttagctgctctggttatctcttcctgcgtaacaattatcccaagccttagtagcttaaagtgacaagaatcagctgggtgcaatggctcatacctgtaataacaatactttgggaggccaaggcaggaggattgcttgaggctgggagtttgaggccagcctgggcaacatagtgagaccccatatctacaaaaaaataaaagaattaaccaggtgtggtggcacacacctgtagtctcagctattcaggaagctgacatgggatgattgcttgagtccaggagttcaaggaagcagtgaactatgatcactgagatcataatcatcacagagtgtgagacccagtttcttaaaaaagaaagtgacaacattttgttaactttcctagttttactgggtcagggatttaatagaggtttacttggacagttctaaacattttatcaacttttctctctaatatctttatggttttttatg

SEQ ID NO: 137993 - DNA, 3879 bp, Homo sapiens
cctgggctctgtcctggctttattgaagcaaaatagtagtgtattagttctgagattgggtaatttataaagaaaagagttttcattgactcacggttttgcaggctgtgcaggaaatatagtggcttctgcttccggggaggcctcaggaagcttccaatcatggcagaaagcaaagggggagtgaggcacctcacatggtgggagcaggagcaagagagtgagggagaggtgctgcacagttttaaacaactggatcttgtgagaactcgctcactgtcacaagaatagcaccaaaggggatggtgttaaaccattcatgagaaatccaccttcatgatccagccacctcccaccaggccccacctccaacattggggattacaattaacatgagatttggtggggacacagatccaaatcataccaattggatttgtggtgtgggagtaaatgtgtctatattttggaaaatctcccttggtaagactgaccattgcttgaatgatttctttgagcttaactatcaacaactccttttcttgtaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtaagaaactattagatgattcaataatttttagttaaatttttaccaatatttgggtgtgaggcagctgcctcacatcctgctaagtcctggaggtaaattggtgagtggggtggggaatccacaattcccctgcctttatggagctcataaacaaatgaggaagaacaaaattgggtgatttcaaacacaatgagcgttataaaaagagaaagaagtgctacttacaaatgggtagatatagcaagtaggtttcacctaattagcaaagactggcctaagggcagctaggggttgggaagagctgtagctagctaaaagcctttttcagaaaatgctatttcagcatttttaggtatgttttctttattagagttgaatcagtaagtcagttttgagtgtttatgtgaattaatcataagggaggttctgtagttcctaccttttgagttgctagtcccctttcttgctcagtgtttactatcgaataaaggaaaagatgatgaaattatctcatgggtttttttttcctgattgactcaataaactcaaaggtatttttgataggaagccattctctttttggataaagttgctctctttttacaaaaattattattattattttttgagatggagtctcgctctgtcactcaggctggagtacagtggtgctataacagctcactgcaatctctgcctcctggcctcaagtgattctcccaactcagcctcctgagtatctgggactacaggtgcacaccaccaccacgcccagctaattttttgtattttagtagagacggggtttcaccatgttggccaggctggtctcgaactcctgacctcaagtgatctacccgcctcggccttccaaagtgcttggattacaggcgtgagccactgtgcccggccacgtttctcttttagagtattcttatgtttctttgaaccatctcagggaatacagaacatctactgtggatagcttagagaagatgaaggaaagtccccctgttctatgtttgtgttaacttgtttctgctttagtttggtgggaaaaaatcccatttagatgtaagaaattatttagctaagtgtttttttaatgctgtttcttagaagttttggttatgtttttgatgtgtttatgtaaaggaagtttttaacttggacctttaaatttaacttaatgaagctgttatttttaggtgttcagtttatgtgggattgctgctgtgagtctgtgaaaaaaacaaagaaatctccaggttcaggatgcattcttgcccactgtatgggccttggtaagactttacaggtaagagctgaagaatatgaaggtatcctgtttttgtggattcattaatatatattggattctattatgtttcaggcacagtcgtaggggctgaagataaagcagtgaacaagaataacaagatctgtctccaaggagcttatattctagtggaggagagagctgctaatcaaataagaaatatgtactttcagaaaatgaatgttaagggaggatattgagttaggaaaggcatcttttaggaggtaatgtttgagcagaggtcctaatgaagcgaggctgtggggtttcaggtatggccaacaacaactgcaaagattctaaggtagaaattacctttttttttttttttttttttttttttacaacttttaacggtttatgatgttaaagtaatgacaaagtaaagtatcttttactattaaaattgctgcatttctaaatggcaggagttgtagcagagatgtaaaattggtgaatgtatttgtacttttaaaccataaagtaattatagatttaatgggtcagaacacattaaagtggaaaaatattatgtaacatgattctcttctaaatgagcgatggtattttttgaaagactatagggacattctgtggagacctaggacttagtattggtatgggatcattttatactattcacattgatcatagaatcatggagctttagagttggaagagcctgatacatcatctagttgaactttggcattttactatctctttccctgtgccttgcctggtttggaaattctggccgtttattgtttaagcaaaacaaagctataatattgtaagattgcttaatttattaaatttttttgtggatatttaaacgaaggtgacaatctgttttcttataggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtaacttattttaaatgttttctattattaaaatagtcacatgaaattcatatagtaaactatttttaattttttttaatttttaatgttttttaaccagtgatgcatatttcagtgggaatatttaatattcacatgtttttagtagctacttaaaaaaatctttatttccccacaaaaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggtaaggtattaatagacagtgacataaagaagcaagttgaataaaaaatgtgtttatattttaacaaatagtaattgcacagctactaagtatctggtctttgttgtggttatccttcaggtttttgccttttagaaaattcttagtatttcaatagaataaaatcacccttaatgtcgccagctgttcagaatttatttgctgagtctgaaagtgtttagggttttaggggataccttgtaaacacttaaaaatgcatcaaatgcctgtgttgcaatcaaagattcttccagctatccaaatattaggtgataacaagagctctctccatatcctgaaaacagtttgtgtctttccaaacttcatgtcattagaagaattgctgcttgcttatctccttttaaggggccatcagtatgaaaggttaatattttcaatactgttgatccttatgtgatagtaatctgatgtgagagcc

SEQ ID NO: 137994 - DNA, 1325 bp, Homo sapiens
acctaatccaccattcatggtcacctaggctgattacatgtctttgctattgtgaatagcatggcaatgaacttatgagtacttgtgtcttttttggaagaattatttattttcctttgggtatatacccagtattattagttaaataaagtttccttatattatagcttgagtgcataaacacatctacttagtcactaataggcagatgatttctttttaacttatctcctcctacatttaggatgaagatacactaatcctcaatcctgaagacaacacttaataacaaaagtatcatcaagtcactgatgaacatatggttcagaaatcttaattaaagccttgtatattagttttttttattgtggcattaaaatgtaccacacacttaacctcttaagacaaacttatttgtctcacgggtcaggaagttgggaatagcttagtgagcgtggctctactgggttttctgcttagtttcccaccaagccgaaattaagatgttaactagagttttgctttcatctaagactttgtatccttttccaactcacttgttggtagaatttagttcctttcagttattacacttaggtccttagctactagagttctctctccacaacatggcagattgtttcatctttgagatcaatagaaaagcatttcagtcatttaaagggctcactttaattaggtcaggctcacctagaatatctcccttttgattaaatcagagtcagcttattagtgggccaattatgcgaatgatagcccaatcatatttacaggtctcaaccatactcagaaggtgaggggattatgcagggtgtttatatcagatgacggtaattctggggccattttaggattctgtgtaccacaccttgtaaacaggacaagacatttagggaattttccatttttatataatggctttaccccagtgatatgaagctactacatatccaggctaggacacagtaataatttagtgaatacttagcctatgccagatactttgcatacattgccttattcagtctccagaacaaccttgtggaaactattgataatcattcccagtttgcagattcagacacagaagctaagagggtttaggtagcttgatgaaatggaatttgggtctgaatggcctatgctatttttacttcaccacactgtttctcagcgttaatcttggtttgtatatcacaattttatgtaagtacaatatctattcagataatttactgcaaatctgtgacttatttgtagttttttggatgtgacaatgatcgtatggttttacaaagaggaag

SEQ ID NO: 137995 - DNA, 1718 bp, Homo sapiens
tatatcagaatttcattccctttttaaggtgaataatattccattgtaagtgtgtgccacattttgttagcccagtcatctgttgatggacatttgggttgtttctacctttcggctattttgaataatactgctatgaatatgggtgtttacatatctgagtccctgtttttaattattctaggtatatatggaaaaatggaattgctacatcatatagtagttgtatgtttaacttttggaaaactccacactgtttttctctggtatctgtaacatttgacgttcccgttagcaatgtaccaagattccaatttgtctgcatctttgccaacacttcctttgtttctttctttttttctttttttctttttttttttttttttaacaagaaacatcctaatgagtgggaagtggcatttctttgtggttttgttttgtattttcctaatgactggtgatattcaacatcttttcatatgcttatatcttcttttgagaaatgtttattctagttggtagcccatttttaattgagttgtttgttttttttaataggtgttgaagagttgttttttttttttgagacagagtctcgctctgtcgcccaggctggagtctgatggcacgatctcggctccctgcgagctccgcctcctgggttcacaccatcttcctgcctcagcctcctgagtagctgggactacaggcgcacactgccatgcccggctaattttttttttttgtatttttagtagagacggggtttcaccgtgttagccaggatggtctctatctcctgaccttgtgatccacccgcctcggcctcccaaagtgctgggattataggtgtgagccaccgtgcccggccgaagagttgtttttttttttttaatactactctattgctgaatataattctaaaggttttcagcatgttttcttccaccttttcctgctgtgttaattaatggaatatgaaatggataaattaaatgactttgtactgtttacctctaattgtttaaattctgtagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtaactaatttctttcttcttctttttcttttgtagctacagggtcttgctctgttgcccaggctggcctcgaactcttgggctcaagtgatcctcctaccttggcctcctaaacttctgggattacaggcgtgagtcaacacacccagccttaatttatttctattaatgatttattttatttggtatatgacttcaatatatttcagcattttaagagtagaatgttgtaatctaccacagatttcttttttttagacggagtctggctctgttacccaggctggattgcagtggcatgatctcagctcactgcaacctttgcctcctgggttcatgtgattcttgtgcctcagcctcccaagtggccgggactacaggcatgcactaccacacccagctaatttttgtattttttagtagagttggggtttcaccatg

SEQ ID NO: 137996 - DNA, 1082 bp, Homo sapiens
cacatccttactgacagtggttattttgtctggattaatgtagctttgtgtaccaatttctaagcccagaaatatttttctcaccaaaagttgttacttttttttttaaatctctgtgacctgttatgaagaaaacagtattcaaatttgtaatctgcttttttttagtgatgatgaatgttttttagtatgtctattggctgtttgtattttatactagaagaatagtcttaatgtccttttatgcatcttcttactcatataacaaacctcccctcaggatactgtaaaatgttgatcattggattaaaatgaagggttaggctgctgctggaatatccattttgaacctattgattttttttctgtttgtttttaggaatgcatacagaggtagaacagttttaaaatagtacataacttattgatggaagtttatcatgaaatattttattttgtgttttaaattttcgtcaggtctgcaaagaaagcagagttggaagaaaatcagcggagctataaacagaaaaagaaaaggcgacgtattaaggttcaagaagattcatccagtgaaaacaaggtaataatgacatttaccacatgcttgaattataaccagtacagtagactatggtaattatgctgttacctctctgttccattcattcattgtattgtactggcttatttacattttacacttgtggaaggattggttattgaatatatatatgtaaaagtattgatttgacattatcatttttttctattccttaatttctaatggaattttatttaagccattctaattcattattttacatttgtagtgatgtgagtgttctattttctgaagacaaaatactatcctgaatgatgactcatatatgaataaatttcttctcatagtgaaatcagccaatttgaatttttgtatttaagcaggcttacataaagtaaaaggtgtctgtaatatgtttgattctgtcaacacaatgctcttcagagggatatttgtcttttgaaaattaacttttaaaatattttaaaatgtacagttcagtggccttaattatattcac

SEQ ID NO: 137997 - DNA, 1066 bp, Homo sapiens
tgctaattttgtatttttagtagagacggggtttctccatgttgatcaggctggtcttgaactcccgaactcaggtgatctgcccacctcggcctcccaaagagctgggattacaggtgtgagccactgcacccggccctaaacagatgattttcaaagcaaaatattttataccttacaaagggttctataaatatataggtgatatttagtcaatatttaataatagtaatatgtcaagtctgatgtgtgagattacctgataacaccaatgataccaaagtatgtgtctaactctgatttttttcataagttgcagtagttgtcaacaggcaaaatagatatacgaggcattttaaaggctgaagaaggttttattgatttatttccttcatttagaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaagggtaagatgttttaattctgaatgtaaagaacatattggaccagacagtggcttatgcctgtaatcctagcactttgggaagctgaggtgggcagattgcttgagcccaggagtttaagaccagcctgggcaacatagggaaacctcatctttatgaaaaatagaagaaatagctgggtgtggtggtgtgcacctgtagtcccagctacttgggaggctgaggtgggaggatcacctgagccccggaggtcaaggctgtagtgagcagcgattgcaccactgcattgcagcctgggcgacagagtgagaccctgtctcaaaaacaaaagcaaaaacaaaaaaaatactggttttgtaaactaattatagtaatgaaatttaagtgtatggccaggcacggtggctcatacctgtaatcccagcactttgggaggccaagtcgggtggatcacaaggtcaggagattgagaccatcctggctaacacggtga

SEQ ID NO: 137998 - DNA, 2430 bp, Homo sapiens
tgaaattttttttaaaaagatgattttagagaatttttccagaaagatgtatatcttcaatttaaagggtttccctttattctgaaactgtttcctaatttggggagggtatgttgtaaatagtctttattttataaatgatgaaagtaaatggaatttgggtttaaatttctttttttggcaaaatgaaaagttggcaaccctgtatttgtcccattttaagaaagcttacagtgtgcaaaccattgatctagaaatgtaagagcaaaactttatagctcaactttagtaagatttaaattggtgtgatctaatcttcactttattgaaatacaaatcagggcagaaatcctcagaaaagcaaacccatctgtggcttcctttagcaattgatgattctgtgtgttgtctaaatattcctgatccatctgtttgagggagaaagcaccaaaaggcatataataaacatttatggaagtgattgcctattttgcttcagtctatttagatgcctttgctatgcatctttgaatatgaatagtaatgaacaatctatctgtcaaataaaatttaggaggcagctaacatgcattaatatctcctgccattgaatgaattcttcattgaaatgtgggtgcgtgctaagaagtgtaaagaggggtttcaaatccagaaataacaaatgttccatcatctcagctacaagtttttgacttagagagtcagtcttgattgcagagaacatgtttatcccatacagattagctcatggcagactgtcaggatcatgccatcttctttttgaacttttctataagctattttcttgttaccgtgatttgtgaatttatattgaaaggatacccagacttatcaaaacatcttgtcttgcacaaaagctgtatgattgctttaatcttacattttcagttatttttcttgagtataaacatggagatttcctaggaatatattttattttaacatatgatggtaggagtaaaagtagtgttttcttatgcttttagtaattgatttttccattagcaaattggtctttgaggagcatcttgagaaattttgttgtgagtgaagcaactgcactattttttttaaagtaacccatttatggtaattcgtgttctttttaccatgtatgtaattaatagcactcatgtcccttctttcccctgtcttgaatattattagagattatttattgctgtaatacttaacatttgtgtatgctttcatctggttcacagcatttatgtagtacattgaaattaaggtccaaaactatcatcctctagtttgaagcaaggtgtcattatatagtggtttattacacattggttttccaagaatatattttgctgttgaataaaacctctcgtggagttttatcttggaatgccatttatctgaacaagttcatttactgttgttgacctgtctgactttgtagttgtaggatggtgtcagcaaagcaaatagaggattggaaggttatgcagcatcaaattgcaattggtaaaaatagtcaatagaatatgtccttcagagttttcaatatattgcagaattgtatagaattgagaaataataagtgtaaagaacatttttaaaagtttttgtttatagcttaggttaaaacatggttttgctagttgtttatttacaatataaaatctattggcacatttatttctattttgattcaaagaagtctgtttttatttttaatttggtgtatttcacccccagatatatagttctttttttattgttttttactctcaagaattgccaagaagatgcttttagaagaaattaaagccaatctttcctctgatgaggatggatcttcagatgatgagccagaagaagggaaaaaaagaactggaaaacaaaatgaagaaaacccaggagatgagggtgagctccccagagagaagtttataatgtcataatttgattccttgactaattcagtctttgaagaatatctgaccaagaaatatcttaatatggcccggcgtggtggctcacgcctataatctcaggactttgggaggccaaagcaggtggatcacttgaggttaagagtttgagaccagcctgaccaacatggtgaaaccctgtctctactaaaagtagctgggcgtgatagtgcgtgcctgtagtcccagctactcaggaggctgaggcaggagaatcacttgaacctgggaggcagaggttgcagtgagccgagatcacgctgctgcactccagcctgggtgacaaagcgagactccatctcaaaaagaagaagaagaagaagaagaaaaaaaatctcttaatacttgtatttagagttcatggaaatgtttaaaactttattaccatgacttctcttgaatatcttgtaataattatggaagttac

SEQ ID NO: 137999 - DNA, 2621 bp, Homo sapiens
tacacttatttttaaaaatgggggtcagcgcggtggctcatgcctgtaatcccagcactttgggaggctgaggtggatggatcacctgaggtcaggagtttgagaccatcctggtcaacatggtgaaagcctgtttctaataaaactacaacaattagctgggtgtggtggcacacacctgtagtcctacgtactcgggaggctgaggcaggagaattgcttgaacctgggaagcagaggttgcagtgagcctccctcactccaggttgagattgtgctactgcacttcagcctgggtgacagaacaagactttgtctggaaaaaaaaaaaaaaggcatcatctgtatttgcccaggcactcattagcatacaagtattaacaagtagagggtatagtgctggcacagtaaaattaatagcagattgggatttaggatcttaggttctactcctgactttgccactagttagctttgtttctttggctgagtcatttcctatatctaagcctgtttcctcatctgtagaatgacaaagctgtactctgaggtttgtccttctggctctaacattttgtattgcttttgttaatggctcgaaagctccctggtgcaggaggtccttctcttgattgcattttaagaaactcaacatttcgaattattgatttacctatcagcaagaggtggtttactttcctttcctgtttgagcgtttaaacaagcgacattactcatttcctttctagataggattggagttaataaaggctttcttggctttctcctatgtttttttttttttttccccgattgcttgtttgtcattgtgttgttgggctcacttcttattattttatttgtgctttcttttagtaatggtgttatcttggtgttcattatgtactttggaagacttagtatatgtgggttttggggtcctatttattttctcatgcgccagttccgatcattgtttgtttgtgggtttttacccttcctcccatattgttttgctttctccccctctcccttccctccctttcaggaaaatggaggagtggctccattacttctggctctgcccaggttttctgccacaagagtggcacggcctgtgcctctaatgcttctgatagagtcgtgactgctttggatgctacacctgccccaagatgtaatattgagcattgagattccaggggcagtacatcgtcctggaaagcctcaagaaaggaaacttcagagcaaacagaatcaactagggatcatgactatacatccagcatgatccagcatgggtccagccgaggcctccaaaatgatgctttgccagcctcagctggttctcaagtgatgatatccttgaagtctctgtggcccgtgactccagagttaaggtagtggagtttccctttaaagcatctcacagcaggctttgtagatgggacacatctcacttcaacatgcttgctgactactcaggttgaaggtcagcctcagcccttaggtccgttaaattaagttctaattttgaaatgtaggttattatgttataggctaggtttatggtagactgggtctttgacatattggacttcagtaataacttatgcaaaatgattcaacttattctttttagggcttaatttacatagctataaattaggttttcctttggacaaaaggtgttagagggcaaaaataaaacctttagccaggtagtctccatcactctgtatataatttgtgatttggagaaaaatgacctgaagtttgtaattttttggcttctgaatgtactatgattgttctatatgttatgatcttactgaaagttgtcgctaagttgtacttctacagtatgtggatctgatttcactttatatgatttattaataggtatacaattgtattttatctcatgtacatcatatttcttagtctaatgacaatccagaacttgagaatgcattaagtaggtttatgtattgtgactttccgttttttagtagacatattctttggagactgggatttgaaagaagaaaaattgtgtgatttcctacaattaacaaccaaatctttatagttaataggaattttttaaagactttttttgaacttgtaaacacaaactgaaatcaggttgttgaactaggctttcaagtaactagattaggaattgtatttttgttggctgtttagtgttcaacccaaatgatggtatgagatcttgtacttgcaagtaaactgtgtttttccatttctaatccagtattcaatgcttcacatattttatacacacacacacacacacacacacacacacacacacacacatatttattcgtcccaaaattcattattcagattagtttgaggaagtttttctggtccatgagaaatgacagtgtagtattactaaagatggttttaatatataccaacagaaaaaaaaagtgctgtgccagacatagaaatttgctgctaacattttattttagtatcttctagtcttttttagggacatacaaattttagaagttttttttttttaaatagaactatattgtggtttataaattactttttcactgaatattaataaatattttcta

SEQ ID NO: 138000 - DNA, 1753 bp, Homo sapiens
tgctaatgatttttttttttcctactggcttggtgtgggtatgctgttgatgacggctctgtattgttaatccagcatattttcggaggaaactaatgatttctggatgttatttatgcctaagaagatatttaatgattgtttacctgatttcagcacaattaatggcatggatgtatcacaagtcccttaatcgtttgatgttcactttgctttcattttaaacactttttcaaatgtctgtctcctacacatgttgtctattctctatgcaaatttgctaaatttggaataatttttttctgtgattttttttttgtggtagttctgtttcgttagcaaaactgctttgattctcctttattgtacttgaaaaacaaaggtggcgttttaaattaagtattttacttgtttttccatttgagtaagggttttaaatatctagcaattttacggtaatttttttttcaatttcctttgtctgtatagcacaggtaagtattgcaagtcatttaagtataacacaggtgtccagccagtagataggatctacttgtagatatctgaactggctgtagttgttactggctttcttttttctactagaattcccagtcaggaaagacatatgatgtgtagtggtgacctttgtccttctatggtcaagatttaaacattataaccagtgtttctttcttgttctctgttctttggtgatattgggactttcagaaaataagaaataggtcttcctcaaaaaagaaaaaaaagaaaaagagaaaaaggaagagtttggatttctagtgttaggaaaagtgattcatttttctgacttaatatcctttgtctttaactttgaaatttcaaaataaaattttgaaatttgagatgagtaaattctgtgttttcatttttcaagtataaaaatattgaactagttatttaatatgatcaaatttcccatattaatttgaatatattttttcttgttaaaatgcctctaaaactggtttagatttttgtataaaattagggaatacacatgtaataattcaggcctattgaaacataagtctgtatgaattattaataactgtgggttcttaatttcatagtttttattgttctacctccaagatttttttaaaaagtcatttgatattaattttcctggtaccctcaccaaaaaggatacagagctacttttcattaactacccacattgtaggatttgcgactaaaaaaaaatatttcaaaccattgtttagctttttgattatttggtgacttcattattatctcgtgaattccaccattttggggtacagatcattatgccttagttttatatatatatatatatatatatatatatatatatttttttttttttttttttttttgagacagagtctcactctgtcacccaggctggagtgcagaggcatgatctcggctcactgcagcctccacttccctgtttcaagcaattctcctgcctcagcctcctgagtagctgagattacaggcacccgccagcacacctggctaatttttgaatttttagtagagatgagatttcaccatgttggccaggctgctctcgaactcctgacctcaagtgatccacccgcctcagcctcccaaagtgctgggattacaggcatgagccaccgtgcctggccagtcatattttttaatagaaaacttaagatactaattttgaacctgagttgaaatatatactaatatg

SEQ ID NO: 138001 - DNA, 2214 bp, Homo sapiens
agttttactgtactgaactgtatctctgggtaactcaggtcacaaataccatacacattcaactgcattttaaaattacttgctactaccaaaatattaatactgtttttgctattcctcgaagatacagcaccagttaacgtcaaaattaaaatggaccagtacgaaggttattgtggcaagaaacttatgctaatatgatggctgttgatacagaattgttactgagaagggtggactttaaaagccttgtgccctgggaaggaactctgaaatatataaggtccagctatttatcattttactgctggcacttcacaaataacctgttatgttttctataagaatgctttttactcatattttggagtccagagtttagaccccacttagtttgctttaaagtttttggctttcagttttattttacatggttttaattatatagcttatttaaagctaattttaagtacacttttttccctcaaggagatgaagccttatctaaatcagtgcctgtcacagtggatgatgatgatgacgacaatgatcctgagaataggtatgattccatctgtaaggactttaaaaagattataacacaccctaggcatgggcacaaacagcagcaacggaacagcaagcaggttgtaaaaaccaggagtgcctgccttagaaagactcgctcacagtcttcctgcaagtttgaaagaaaggccagaaaatgggctaaaactcagaaaccttaagagaaagtaatatcattatttacacacctagcatagggtgtgttataaatacagaactgtcaattttatgttgctatgtaaactgcagtaatttttttggaataatttattttgacagattattgatgaaagtaaatcatatctcagtaaattggtaacaacagacatctcctctatatttgactattgttaattgccatccaatatggtggtcctatttattaaggcctgttgagaagaaacaaaaagagagattactcagatatttaagattaagaaattgctttcaaaataagtgtcagtttacaaggtatctagactgagttagagtttaaccagttttcaaataaaatagaaatacacggtatgagagcatttactttaataagacttaataggtttaaatgtcaacagtgtagcctatacagatatacttaagtaaggggtggctgggtgaagaaaaaaaaagacactatcagtgtagtgaagaataaggaaaacaacagtattaaagactatagctataatgtttcaacataacttttaaacacttcctggacaatagcataccccatgctcataatcttcaacaagaagacagcatggtatagtgcatggaattttggaataatgggcataagggtatctgatttctaacatttttaacaactgtctgtgtcatcatgggcaagtgactttactttttgtcaaaaatttactatatttaagaagaaaaagttgggcgaaattttctgtaattctagtaccaaaaaatccatgatagatttgagatgatttcattaaagagcactacattaaccattcatttattcctaatagtaagttctaacattaagaaaacataaaaatatacatgtaattttctgtcataattttgtaagaaattaactgacttagtaaatgccctgggttcagctgttagtttcgctcttttatatcttgctgatgctgttaggtttctctgtttcaaaggtcagcattctgctaattaacagaagaatgtttttattaaggtgaatgaacagttttattttacagttttgaatagagcttaattgtggacacaaatattcagattctgcttgcctacttttttaaattaaaaaatgtatatccatttattttatgggataggtggtaggttccagaatggagtgataagggcatacaatttattcatcagggattttacattatatcatcacagccagatactgaaagcatttaaaattttactcttttttaagatgctttaatttttcttcatttatatttgctatttgattttctatacatcatgaggcctcagatgttactcaaaggctaataatgttttaaacattctatatcttaatttaactgtgaatgatttactttaatttcatatttaaccaccaaataagagtgttgttaaggtataatttttttgtgtgtgttagagctt

SEQ ID NO: 138002 - DNA, 2433 bp, Homo sapiens
attgtgtttaaaaattagttaaaatccattaaaaattatatgtcactgagctaattttatttctggttttatttatttggatcttctctctttttttcttagtctggctatttttaaactttggaaaattggtttctgtgattaaacagtttcactggtgaaatcagtatgtttgatttcaagtattttactacttttcttaagatctcacttgatttattgatacctatgaaagtttctgttatgcacctctcatgttgagaattattaatatttagtgtaataattaatatgaattcattaggccttaagaagggatggtgatatatggcaaatactcaattgatgcatctcttgataattacttatctcagcactgatctagatcactgtgttccattttgatttatttaactttgatctgaaggacaaataggctgatggggagtaaactttttctcaggtgtgtatcaagagaaactttgagaattcgtcacttcagcaaattccaatccttcaactgcttggtgaaataagccttgttgagattttctttaccctggatatttttgggggctaagctgattatttgggatgaaataagaaagaagataaatttgttagggaatttaacctgtgaaaaattgggccttgtcaatagaaacaagtagaatagaatatgagtgccttgaaaataagcgctgtaaaaagttctgtttttaaagataagtttgcgtgtgagccagtgttatgatattccttcagaatttacttacatgcttatgtaagcatgctgaatttatgtactcctctgtctaacttaattttaggtcacagttttagaaggttaaaagaaaaaccctgccccctattgagtttagaggattccagtttattcgcagtatttgggtatcatattacagctacagtattttcctagaaattggggcttggtaatggcatgaataaccaagatgaagaacatggtcctaggagattgcagtttaatgcaagacagacatagagaaatcattaaaaaaagtaacagaagaaagatataaaactagaatggggcctgtaatcccagcactttgggaggccaaggtgggtggattatctgaggtcagtagttcaaaaccagcctggccaacatggtgaaaccccatctctactaaaaatacaaaaaaattagccaggtgtagtggcgcacacctgtaatcccagctacttgggaggctgaggcaggagaatcgcttgaacccaggagatggagattgcagtgagccacgatcgcgccactgcacttgagcctgggcgacagagcgagactccgtctcaaaacagaaacagcaacaaacacaacaaactataatggggctacacaataaatggcaagtgaactacttaaatatttggggaaatatttagaagaatagttggcatttgaacttcaaaggataggtcaaattttgaaaggtgtagtaaagagggagtgacagtactgttactaattatatttcatttgaagattggtctgtttgaatgagatatttattgtgagtttgctgggatattatgaaatctcttctctctctctgtctcttttttttttttttgagttgaagtctcactctgccacccaggctggagtgcagtggtgcaatctcggctcactgcaatccctgctcactgcaacctctgccttccgggttcaagcgattctcatgcctcaggctcctgggtagctgagattacaggtgcatgccaccacattggctaatttttgtattttcagtagagacagggtttctccatgttggccaggctggcctcgagctcctgacctcaagtgatccgcctgcctcagcctctcaaaatgctggcattacaagcttgagccaccacgcctggccttatttagtgtatttctatcctgagcctgtaggtgtctgtttcctttatagattttttcctccatttcccttcaacattttattgtgaaaaacatttaagtatacaccaaagcatctaccattaatattatactgtattttcttgataacatatctatatatccttctgtctatccatcagtatatcttttttttgcctttttagctttttattttgcataattataaatccacagaaatttgtaaaaaaaaaaaaaaaatacagggaggtctcagataacctttacttagtttccctcaagggtaatatcttgtaactctagtacagtgtcaaaaccagaaaactgaagatttattcagatttcaccagtttcacatgcactcatttgtgtgtgtataagtatagttcagtgcagttgtaccacgtgtgtatctttgtataatcaccaccacaaccgatatatcaaaccagttccattatcacaaggctcccttgtgatactgctgtccttacctccat

SEQ ID NO: 138003 - DNA, 4589 bp, Homo sapiens
ttaacatttctctgataatcaatgatggtgagcagcttttcatatgcctgtttgtcatttgtatgtcttctttggagaaatgtccagtctaatcttttgcccattttttgattggattatttgattttttcctatagaattgttggagctctttatatattgtggttattaatccattgtcagatgggcactttgcaaaatgttctcccattctgtgggttgtcttttcattttgttgattgtatcctttgctgtgcagaagctttttaacttgatgtgatctcatttgccaatttttgctttggttgcctgagcttgtgtaatatgctcaataaatctttgcccacaccagtgtcctggagattttccccagtgtttttaattacttaaaaaaataaagtttttgtcctttatgaatgttatcaattttgaattaaatttccccttcctcttttcttttaatagaattgctttaagtattacatgagtgatgatattagccgtgactcagatggaatggatgaacaatgtaggtaggtaatatagatgagctaacattcagtgtttcctacttttgggaggaattgttacataatcatttatgaggtttgtctttcatagtatcgtcattgatgtctttaatgaaaggttgttcttttccataaaaccctggatttatgtctagtttaagtttctaataaagagtaagcagatgacctaaattaccactaaaattactggcagtaaaatttaaattgcattataacaaagagattaaaatgagttttgttgggaataatgtttatttttatttttttacatatcttttcagtttcctgaaagaagggaataatgttttaatctttaaaacatttcaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggtatgcaaaaataaataaaaaattcataatttgtacttccccctcttgagttactacattgtttaatttcctctgaagctaatcaaatttagggttactacttaggagaataccacttaaaaattatttaggagtttattaaaaaaagtttccctatttatttttatgctgccattggaagatattttgaacattgctagtattcagtatcagggatctcaaatttgttgagtaaatgacaaaatttctttatcaatgtttagtgcttttctctggagtaatgagcagaaggaaaagcggactggtgccagtggttcagtagctatttagttatataatggaagtgagtgcttggtactggtatgacatggtgtgtcaaaattttaactgccatgcatatggctttttaagtttgaacatataactttgtgtctcatgaaatcccctttaattatttttaatttacctcattaaaaccctttgttgatgcttattaactagtttctaatgacatgaacagatgtttttcttttaaaaacactgtcaaaatgaaggaagaaaatccaaacattagctggattagcctaccctgatgaggtagagtactaggaacattaaagtttgggtcagctggtga

SEQ ID NO: 138004 - DNA, 1294 bp, Homo sapiens
attggtaatatcataaaattaccaagtttttacataccatattgataggatctgtgcagacaattccaatgagaataaaaacctttatggcatacttaagtgtaggattgcaaaagaatctgttccgtatatgttacttacttccccattctttaaggactgatactgaatttatttgcaaagcaataacaaaataagagctcttggcccctagttttagaactttttatgggttctcttaatgttatttcaagttgtaaaaaatggcatttgcatctgtaaaaggaaacaattaggatttgtaacttggaatttgccaaggttgtcatgtgcttagtaagtcgataaaatattaaccttttttacttgtgtccaatatgccatttttctaaggattatgaggtatttcatgtctaatacaaaagttacaaaatgctgactaaagtaagtatctttttctgtgtataaatgtgtgaataatagccactcctttctcctagaagatgggcttcatgggattgtgagctgcactgcttgtggacaacaggtcaatcattttcaaaaagattccatttatagacacccttcattgcaagttcttatttgtaaggtatgtaatgatctgttgatatttcataccgtaaatatttgaatgcttaccatataccaggcctttgagggcacagtcttgaagaaagatgaaaatggtatctgcccttggaagacttctactatagtggggaaaatagacgtacaaagcctaagtgtcatgataggggagatactgtgattatgggagcacaccggaagcctgtgtaaataggatttggatggctttctagtggaaagctgtatgtgaaatatgaataagaatcagcctggtaagtgagattggttcatcatgttctgggaagaggcaacatagtattcagatactggtagttgagggagagcttggtgtgtttgaaaatctcaagagtggatgtgtgtaatgtttgtgttttataatctttccccttatatatcctacttccccaaatgtaaactatctatgtggagcagggttttgacataacttggagatgatagaattaaaaatgttttttatgtgttgattataattttaacagtctgtgccacttttttgttagtaataccttggagttaattttaaatatctataaatgtgggcctggcatggtggctcatgcttgtaatcctagcactttgggatgctgaggcaggtggatctcctgaggtcaggagttcgagaccagcctggctaacatggtga

SEQ ID NO: 138005 - DNA, 1875 bp, Homo sapiens
tttaaatatatttcataattaaaaataaaaaatttaaacatgtatacagcaacaagtacataaagtaacatttcaacattttaccatatttgcttcagatctcacttaagtaaaatattggttcagtcctactctcatccatttccccttcttcccaccccacaggtaatgattatattgaagttttatgcatgtgcatgtgtgtgcatgtttttctatgttttttatatatgtattcataaaacatttttcatttaaaagtataacaaaataatatgctgtatatatcatttgggaacgtttttcatttaacattgtttttgaattgtattcatgtcagtaaatgtacatctagtttgtttatttttcactgctctatagaattatgttatatcaataagccactattcatttcccacataggaagttattcccaatttttcattttctaattttctaattagtgctgtggtgaatatccttatatttgattccttgtgcacatgtgggagaaaatctccaaagaattacctagttttgtttaattcttgagcgatgtatgcaccaaagcacatagaagatacttagtaagtattacttaacactggatgaacattcagattctacattttatttatcttgttagtttatctgaatgaaatcattgtttgaaatgaaaaagtatggtgtggtgtatttgtttctgttaaaacaaatacagaatatatgaatacccaagatcaaactggtgtttgtaaataatgtgattataatacattaggcttgtaatgcctgctattaggtaggttgagataggaggattgcttgaactcaggcgtttgaggctacagtgatttataattgtgccattgtactccagtctgggtgatggattgagaccccatctttaaaattaaaaaaataaataaataaaaatattagcaacataaatagtaaaccttcaagtttacttttctaaaaaagtatgatggtgttcttatacattaacgtttttagcttctggctaggtgtggtggctcacacctgtaatcccagcattttgggaggctgatgccagaagattgcttgagcccaggagttggagaccagcctgggcaacacagtgagacccagtctttaaaaagaattagctgggtgtagtggtgtatgcctatagtcccagctactcaggaggctgaggtaggaggattgcttgagcctgggaggtagaggctgcagtgagctgaatttgcaccattgcattccagcctaggtgacagagtgagactctagctcttaaaaatttttttaaagtttctacaaataaaaatattcatgataatatttgggtccatggcgctttggaccttaaacctaacagaaacccaaaagagaaaattaaaagggtgaaaaatatatgtgatgttttgttttttatttaaggatggagccaatttgttttttagttgtctcctttttatttgtgaatgtaagcattttgagtgacttctgaattataatctaccatcttattttgatcaaggtcttggttgcacatcaggatcatctttgaaactttaagaaaatgcctgagagattttaattcagtggtttaggggtgggaatggctgtttttaaaaagattcttcagatgactctaatgtttagctcagggtgtgaaacactgccttagcagaactagggacaagagggaggctggagaggtttctgtaggttttcttcagtctgtttatcaggagacagtacagaatgggactctgcctttttcccccagtcgttctgatgttttgctgccaaaatagatatacctgcaatgtcttgtttgtctttatttggaaatagtagacagtattg

SEQ ID NO: 138006 - DNA, 1707 bp, Homo sapiens
ggggagtggtggctcacacctgtaataccagcactttaggaagccaaggcaggagaattacttgagtcctggagttcgagaccagcttgggcaatatggtgagaccccatatctacaaaaaataaaaatatcagctggacatagcggcgcatgcctgtagtcctagctattctggaggctgaggtgggaggatcacttgagcccaggtgatcgaggctgcagtgagccgtgattgcaccactgcactgcagcctggatgacagagtgagaccctgtctcaaaaaaattaaaacacacacacacacacacacacacacacacacacacacacactctaatattggctaaccatctataaaaagtttgcatcagaaggattcatttagaaataatagtggactatgtgtcccacttgtttgtgtgtgattcttaaatggtgcctatatatattttggggcagcttaataaagccagaattcataactataaaaggaatgaatctccaaatgatagaacatgacactaaatttctaagtagaagtgtagtgaaagcatatccatttaatattgatcagattatataattgtgaaattatagtgaagttcttatattggtgaaattttgtgtggatttttattttaatgctatgattatcttgctggaaccagtaaaatatatctatttttataacatattttatatattcattttccgattaaataatttgtaaggttgttggcaaaaataaaggaaatattatatagtcttttgtccacaaaggggtagtcaactccttttgagcataaggaatctttctgagaatctagttcatggtagggaaactgccattgcagcaacagagctcattaaagctaaggtagtagtcttaaaatttaagagaatcctcaattataaagtgatggtaaagatcagtagtaagagtttctttcctctgatcataggttctctagagaagacaaataactaagtgttctgcattgtgtacacttagtgtacagagtgtctaaatggtgttatttttgggaagggaccctgtagcagtcagtgtctgaaatgtggataagggctgaaagaataaaagaaccactgttgttgacgagggtattcctagtgccactttggtatgctgctgacatttggtctcagctgataagtttcaggaacattttattgaatgatctgtgtaggaatgttttggtatcacgcttaagggaatacatgcatttatagccatcagtagcacttaaatctttcacatctattttcatcttaatgatttgttacatttttaagctgtcagaaatcacacaggaaatttaacactaggtttactttatatacacatatatagataaattggtgatctgaaatactgaattggtgtagttaatatttaaactttttaagaaagctggttccaaattgaagcctaacttaggaaactgtcaagaatgtaaactttcttgtattacaagaaatgtaagacattacaagaatgtaagacaatatataaagtcttatattgatttggaataatattataacacaaagatacggttaaagttaacatttcaggagctgattttttaaaaaattttcagtatcataccctattttgacattctcttcccagtttaattgttagaaagtatattttacacctaacttttttacatgacacaata

SEQ ID NO: 138007 - DNA, 1780 bp, Homo sapiens
tttttttgtcgttgttgttaatttaaaatctttagttcttttcaaatgctggggcttctctgagtgtctacatgcaatgattgctgtgaataacttttttttggtggggattatttaattttactacaatctgtaaaatctcaatcatctgtgtcctccccccccccaccctttcagagactcagaaactcatttaacaactagatgctataacttgtcaaaatttgcttgttgaataacatagagccatatttcagagaaagcccctggtgactacctgcttttttttccttaattgttgccaatgatagccagttactaagcccagcaatgtaggtaaacattgaaacctaaaccctttttactatgcctgtcttatttgctcttgagagaactaatgaaaacttaaattgacagcctctctcttcaattcacatgttttatagttaaggaaggacattctttctaaaatattaacatagggatcaacaaatgatctcattctacaatttattgttagggtacttcagctaaagtatcttaatctgttaaaactctttaaggactttacagagtagtgaaactttgacataccagttgggaaatgctgcagtatagatacaggagtaatagaatgaacttcatttcccccaccaatacccctcccttgcaatataaaactacccttaaaaatctttctgagtttatgatttggattatgaaaataggatgtctttaaaaattttttccctctgaaccacacatattttatgaattctttatggaacttagcatagatgttcatattcataacagcttttgtgataggcactataaaaattcagaactgggttgaggctttctgtttgattcacacatttgttttgtaatcactccataatacctccctttcctgtttttatgaactatatttcaacaaataaactgttgacacctggcccttttactatttccctgttttatttacttttgtgaggtccttacaccaatatctaaagcttgaaagaaacaaactatgtaccagcaatgttggctttatctgaactgaagtcttgtacttcacttgcacatttaatatgtgtaatggttttttaaatgaaatcattctaggtacagtgattgtacagccagagccagtgctgaatgaagacaaagatgattttaaagggcctgaatttagaagcagaagtaaaatgaaaactgaaaatctcaaaaaacgcggaggtaaatacaagtgaaaatgaaacatgaatttaaattgctgtttatgaccatattggaaaatcggatgtgcttactaaaaatacctccacttttctgccttttgtttattaaaagcactacttaaatataacttctgtttctctctgagctctgaagcagaaaaggttaagcaccatttatcgaaacacctttgccttcagtggctattaagttatctcaagaagcgtagcatttccttcttccacatgttctataatacatatatgccataatactatgttttccccccaaccctaaaataattttagattcatgcaaaatcttgtctgtggcctacaggtaactttatatatatttagagttggatagagtgacgtacatctgcattagtattagttggggtattataaatgcaagtcccttgactccactcctcacaaattagaatttctgttgatgaggtcaagaatgtactccagtttgttcttgtgtacactgaagtttcaaatccactaatctaagaatggcaacatgg

SEQ ID NO: 138008 - DNA, 1634 bp, Homo sapiens
tgtaagttataaggagaaaaaagagtggtaaaaaacacttttttctgctaaattgtcaactcaagtcatacataaaaactgaaacttttctaacataatgtagtacccaatatactatgcagtataattgttattagaagtttgccgcttagtctattggactttcattgtttctaaccagtgggaatgtctcttaaaaaccaagcttgtttgatattaatttattctctgaagtagtgattcttaaagaagagtgtcctccagggtctccctggtagctttttcagaatgcgtatgccttggtcctgctccagacctactgaatcataatcttcagtgatatggtatagacatacatgcttccctaggtgattctgatgtgcttccttgttgagacccactgctcaatctcaacatgttatttatgttctttgggtattgttccagttgtcagaaacattcataattctatgaacttaattctttcataggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtaatgtgtgttaatttttcatgaagttaaagttgaaatgaatttttaaacatcatttttataaaattggaacttgattactgttaactatgtacaaacgaccaaacatggcattttcctagtggttgtctagaaatatatttgtatgccaatgataatatgtgttattgaagttaaaaatttggaatattcagttggttttgtaaagaatgaaatctatttttttctttcctttgagttttagacaaggggctttagtttccaaattatacttcagtgtgtaagcaggtttaaaaatttaatatattaggttttggttcagtcaatgttaatgtgcttgctttatacaaaaatgtaatgactgttcctgaaaacttaaaaatcatgtacagtctagtttagtcttattgcattcttaaattccctaaggctaaaagctgaagttaactatcatagatagatttagttgtatttcttgctgttatcttttttaaaaaactttgtcacatacctctcaactgttgaagttctaaccataaaaccttgttaataagaatagggaacaatagccaaatgaatatcttggactcttcatagctcaagtctgagagcaatataattggatgatgagaatgacagggaacttggttcaaagagtcaaattttagattttttttctttgttaaataatatgttgtagtctcttggcacatttttcaaattcattctcatagatcttttacagcagtgcttattaaaccttgttccctgtctatgtttttatgacatattttcaaattatggaagtttaaaaaatacagtaggtaggagggatgggactttccttgactaggataaattagaagttacaaaaggtgataaatgaaatgaggaaaggaaattaatgaaagaagagagataggggcctaccgcttacttagttttgcaaatcatttatgacaattttatgtaatggttttggtggccaagggcagaaacaactaacatgggagtc

SEQ ID NO: 138009 - DNA, 1044 bp, Homo sapiens
tttttcttggtcagtctaccctaaagtttgttcatcttttcttcccccacaggtaagttgttacacaatccctagcagattccaactttcatggccaaggtcctctttgatcatctttttaaaaaattagtttttggccaggtgcctgtggctcacgcctgcaatctcagcactttgggaggccaaggtgggcagaccacttgaacccaggagttagagaccaggctgggcaacatgacaaaaccccatctccacaaaaaattagccaggtgtggtggtgcgcgcctgtagtcccagctacctgggaggcttagaggggaggatcacctgaacccgggaggttgaggctaaagtgaaccatgatagcacctctgcactccagtatggacaatggagtgagaccctatctctaaaaaaaaaggaggaaaaggaaaagaactactctttggttttattgattttttttttctattgcttttctatttcctatttcattagtttcatgaatttctgccataatctttattatttccttctccttgattttggtttagtttgctcttattttcccagtattttatggtaaaatgaaatatactttattggtagtatgttttttatttttagtgtaatagtttaaattttcttctgctgggaaatgtcttgcaatatttataaactacaacaggaaatgtttttataccaaagtaatctttacagagatttcatgctttataaggaggggttagtatgcaaaaggagagtgattctagtgaaagaacacttctaggaatattttaatgtgagtagtatgttaacaatactgccagacttcatagtgtgagaatgggtttgtggagttataggtattgatgttctgtttgataatgcatcgaagagataaataatgttctttatttcttcttttttagataaaatcagtggttctggaagtaactctgatatgatggaaaacagcaaggaagaggtaaggataattatttagagatatttgttagttacgattaaccaagtagagcatat

SEQ ID NO: 138010 - DNA, 1011 bp, Homo sapiens
tttatttatttatttttatttttatttttttgagatggagtctcgctgtgtcacacaggctggagtgcagtggcgccatctcagctcactgcaacctccgcctcctgggttcaagcgattctcctgtctcagcctcttaagtagctggaactacaggtgcacaccaccgtgcccagctaatttttgtatttttagtggagacggcgttttgccatctctggatggcaggctggtctggaactcctgaccttaggtgatccacctgcctcagcctcccaaagtgctctgattacaggcgtgagccaccaagcccggcctttccccagtttatttgtattcatttttctagtcctcattgtacccacagtttcagagttgttaaccatatcatcgcattaaagaaacgtaactatagttcagtatttctttaaagttctttttgtctttagaatgatgttacgttgtcggagtcctgtgttcactagttgaggaactccttcagtagtggtatctccagttggacaaacagatgtcactcacaaataccaattgtaaattctgggcagcatactgaaggctagatatcaacaaagtagataaactggaggggagtcaacacatggaagaagaagtggcaatggctgaattccccattgttaatcctttttgcttcagccaaggatcctcttagctccatctgtggcctttaagacttggataaaaatctacagtcttattggatgtgaaatcaaggaaaaaatttagggagaccacagcagctgtaacatgagtagagagatcccatctagaaaagagccacagaacgggaaaaccagattgcacgaaaactctcccaatagctctggtcctgttgcctaagtgcactccagattccaaccagcctggttaggactaaaagaacagaacaaaagctttgagttgtttggtactacagggtggaaagggtttggagtttcatttcaagtaagttaactatctgtttgtttggtt

SEQ ID NO: 138011 - DNA, 1057 bp, Homo sapiens
tgtttctttggttttttaaaaatctgaagcagtttgtctgccttttgggactatgactttttttgaaatgtacaggtgtgttactttgtgaaatggccctcaggattatctgtttagttatggttagattcaggttatacatttttggcaggaatactacataaagtggtgttctgttctccatgcatcctgttacatggcacatgatgtgatttgcccctttactggtgatgttaacttaggttgtttggttatggttgtgtttgctaggtaaacccagtctaaagttatgatttattccattgtaactaataactaatttaatggggggcactttgagattactaaggtattctttttattatcaaaacttaatatgttttcttttgcaaatgaccacaaagtttgcagcttaaaacaacccaaatttgttattttacagttctgtaggttcggagtccggtgggccttgctggacccttctcgggctatcacaaggtcaaagtcaagatgttagtaggactaggttcctttctggagactgtagaaaaatccattcctaagctcattcaggttgttggcagaattcagttctttatgataatcggttagaggtccttctttctcactcactattggccaagaccccctcctagttcttttcaggtgtcttcatttcttctcacgtgatgccctccatcttcaaatccagcaacagcacatcaagtctctctcaagctttgaagctctctgacctagctttttgcttgctaattctgctgccacctgctaccagctggagacatttttctgtttttaaggattcatgtgattagattaggtccctctccctctcatctcctcctgattatctcttgagtttaagatcaactgtgccatattacataacacagttatgggagtgatatgtcatcacattgataatttctggggatttgcggtgtagaatcttgtgggccattcctagaaggtctgtttatcacagcatacatttgtgattcttagctgaataatttattcctatgatgggttcaaa

SEQ ID NO: 138012 - DNA, 1114 bp, Homo sapiens
ctcagtattttcgaaatgtttagtaagtaatatcagcagtttccttaaatgatattttaatcctaggtaagtgtacaggtaggttgtgttactcatatttttatattcttagtgaaatagaattcttttttttttttttttttgagacagggtctgactgttgccttggctagagtgcagtggcatgatcttggctcactgcaacctctgcctcacaaggctcaagccatcctcccacctcagcctcctgagtagctgagaccacaggcatgagccacccatgctctattatgagccaccacacctggcctaaaattcgttttctttaatattttttctttctacacccacaactgtaacatttcccttagtttttactttgaatgtgcatactcttacacgacttacagtatggctatattttcagtttgctagagctttacaattaatttaaaacatgaaaggctaattaagggaattctttaaattttgttttaatagtgaaagcaagttgaatacattggtgcagaagcttcatgacttccttgcacactcatcagaagaatctgaagaaacaagttctcctccacgacttgcaatgaatcaaaacacaggtaaattgaaaaagaatgtgctataccttctagtcttttttctattttttttttacacttatggaggtaaccatttattttattcagagagcagcttttaaaagagatttcagtttgtggaaaatgacagattagcaagctttatagaagcccctattatgtatcttagctatatctgatacaggagattttaattttggtaagtatgactatagaaagcttagaaaaggaagcatttatggttttatatgtaatggaaatgtgttatagaatggctagtgaatgttgactgtgaaaaaatagtattagaagaggcaggagtagtataggaatgttttgtcctagcaatcattcatgtattaggagttaaatttttatttttatttttgtgatggagtctcgctctgtcacccagtctggagttcaatggcatgatcttggctcactgcaacttccgcctcttgggctcaagctattctgctgcctcagcctcctgagta

SEQ ID NO: 138013 - DNA, 1023 bp, Homo sapiens
ctgccttggcctcccaaagtgcagggattatagatgtgagccatgtaaataaagttctattggaatacacctatgtccatttatttacattgtctgtggctgcttttgcactgtagttgcagagttgaatagctgcagcagagacctagtagcccacaaagcctaaaatgtttactgtctggccctgtattgaaagagtttgctgattattgtgctagatgaatgcaggatactacacccctctaaaaagagctgcatagaaatacatgcatatagatgcacacacgtctgacatctaccagctacctcatttcaccacttgggttataaaccacacatatttacatctgttgtacaattttcaatccgatttcagataaccttccttctaccacttcacaataattcatgagctgcaacccttttgatgcccacttcacaagcaaacttcaggtctttttcaaagtaaagtgccacatttattgttatatttgagcatttattatttaacatgtcaaactgtgctaccatttttctttggtttctttgttttaaaaaaagtcactgatgaaatttttgaatgttgtgcttctaacctcatttttcctatgagttctatggtgttaattgcacaattttacatagtttggtggtttttaggaacccatatgttacattattgaggaactgactaattatcatcctgtaaaaagtactaattcattcaccaaacatttctggggtgatgtaaatattaagtgagttaaatgggcataaagcacttatgtctttattgttactcaaatattagttattactgattactattaccatgtgtcaggaactgtaataagtagtgcattgatgaacaagacagataagggacctgtctccatgaagcttacattgtatttttaaaaatctattaatatacattttggctagtaaccgagcccttgccccacagaaaagttgtgctgttacacaaaataatattttaagatccatccacaagtcaaagac

SEQ ID NO: 138014 - DNA, 1090 bp, Homo sapiens
agcactttgggaggccgaggcaggtggatcatgaggtcaggagttcaagaccagcctggccaagatggtgaaaccccatctctactaaaaatacaaaaaaaaatcatctcggtgtggtggtgggcacctgtaatctcagctactagggaggctgagacagagaattgcttgaacccaggaggcggaggttgcagtgagctgagattgcgccactgcagcctgggcgacagggtgagagtctgtctcaaaaacaaaaacaaaaacaaataagcaaaaaattctgcttatatgagtgtttatcattttctcttatctgccttttgtgggttagggagaagggtagtggtgagataaagtttctttattcagtgtatttatatctttttgccttaaaacttacatggttaggttacaggtgttttgttgctgatacttgtcatagtatcatgtatacctggttgtataaacatttattggaaaggaaaaaacatttttgttggaaagtttggtaattattgtggcttaggatatgttctattttgaaagattgctatatccagtatatttctgcccttttatgattgaagatgtacgtctgaaaatacctatgttagttctagccggttgttctttttgcgctgggaagtctttgaattttgcactgtagctgctattttcagatcctgtctctgaaactttgtctctcagttttagcttgaagtagccatttcctgtatctgtagtccagcactcttgttaactgtcccatacaatatttgttaagaaattattgttctggcagtagtattcacatgtatatatcctgcactccatattttgggggaatgctttattagttgatcaaatacttaagtatcaatttggggccaggcatggcactgtgttagggttatgccaaaggtaataaaattcctgccatcttaaggcattcttagtcaagtgagggagattggtaagtaaatgagcaattagaaagcagtgctaaaatatggaaatatattgattgcgctagggatcagaaatgaaagaaagcctaatttgggggatgtctaggaaagttttgcaaagg

SEQ ID NO: 138015 - DNA, 1002 bp, Homo sapiens
gtgatgtatgctgctaggactgggaccttcccttcagggcagcagattcccttctggcccaggatgtgtctagaattgtcatcctggagctagggcctggaatggaggcttcatgactgatgaactttaatttgttttctttatttttattttttttgagatggagtctcactctgttgcccaggctggagtgcaatggcaccatcttggctcactacaacctttgcctcctgggttcaagcgattctcctgcctcagcctcccaagtagctgggattacaggcaagtgccaccacacctggccaatttttgtatttttagtagagacggggtttcaccatgttggccagccaggctggtctcaaactcctgacctcaggtgatctgcccgcctctgcctcccaaagtgctgggattacaggtgtgagccactgcgcttggccttaatttatttgcatataaagatttcagtattgggagatttggtgaaatttgtcattctaatccttatggcaattgattacttgaaaagctgacagctatattaccttgttattgatcttaaatataaaaaggcagaagttgtctaaattgagagattttgaatgtcttagaaagtatctgttaaggtggtagtttacaagcagttacattgtaacctaattgttgaaaaatgttatctgtgaaatacttgcatttccactatgaaaagcatgaaaccaggcccttggagggggaggagatgcaaattttataaaggtttttaaaaagcatttaaatatcaatggcttggttatgtaatgggttggggtgaaaagaaagacatttgtgaccttaatttttatcaggcccagttttattattggccacccttggcatagttggccttgagctttcagttatgtattgtatttctagagataagataaatgtagtacttaaaataatatttaagtattgatgtaggtgtgtgaaataattgtttcataagtaattgtatgt

SEQ ID NO: 138016 - DNA, 2294 bp, Homo sapiens
tgagataacccggataaaggattagtgtagtgccgagcatatagtaaactctcaataaatgtaggttgctgttattacttcgttaatatgtcaaagaaaaaagaggttggaccaaaagagcattttcaaaataaagtcaaactatgtcactagcactttcaggtcaattgggactaaattggaccccctgcgaaaaggtggaggggatcaaatgacgtcgaccgccttagcaacaggcccccaaagaaggtgaatttccgtagccaataagactctgtgctttggaggaggtagccaatggctgacggaaagagaaagagggaggacgcgccaattctcctgcctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgaggtaaaacgcaaccccgtctcatgggccccagcggtctgggcccaggcaccgtctgagtcgggtgtttgggaaggcgttcgcttggtgggttaggcctgtgtgttgcttagccgaaagaggcatcgttttctctttaggtgagaagggtttcggggtatcggcgcaaggctccgacgggggtgggggtggggatggggtggggggaggtggggggggcgcggcctagggtatggggcgcttcttgcaatctcccctaaacggtgacgcttggtcgggctcctctgtttattctttggtgcctgtgggattgagacctcgaagtcggaggcggtctttggtatcccggtcatttttgctaatctttgggcctagaaactgcgtggggaagaagcggggggagggtgagaagagggggaggggtgggcgggcgcgaggatgtgagatcccaggacgacttagaggcgtttaggttgctggagatgggaagcacccgggccctgcgggattttttctctgcagccccaggagacaagcctttttttgattgggttgtggtgcagttccaggtatttaggtatcttttctactccatatcctgaaggatatccttgggtttatttctaggcgaggggggacttaacacagggttttgcttccagaggaccctagtatactactttttgtgatgtccagccttaatgggacctcaagtgtttccccactttctgggcaaatttcgaggagtaattaggccctatctttatttacttatttattccatgaaggatgaagggcaggttaacgtgggctgatgcgaagtaagatttattgcaagggaaaatgcctggcaggcctcctcttaaccaatcaagcacgtttattaggttgaagctgtttttctgtgtgcttctgatttgcctcttgacgggtctgaaaatttgggtagtcaatatgaaatgtatacacttttacccaggtggctggctggcgtttcagtttgacatttgaattttcatcccacaatgtgaattaagtaatttttttactcggagatgcatccttggcgtccagtggcaaaataaaattacaaggagcatgggtcagaattgcatttcaagttggcgaaatgtgcctttgagtaactcttagattggcatatgtttttagagcaatttagctagaatgtagaattgggcaatgagcctatgatacgtatgtctgtatttctgcatgaacaagcagtagattatattttctttaccttggggaaagatatgcttcagttcttagattgtagatctctagttgtgtacacgattgtggccttggtttctgaatttgtcagtaggctcaaatacaacaaatctttatctgtggggtattaggcacgtaagtggtacccagtataacttgttggcctgtaattaccaggcactcatgttcatatgcatggatggtgtaccttacagttaaattatgacctctagattttactaagtttcacaaagtctacatttgaaactatagtttgaagtcggatcttctcagtttctttagaatgaacaaattacgtatatagaatttctgaatagaataattaattttacacaagggtcagtttttcttactagtcttggatttttgtagatcttgatgataagagtaataatcataactaagttgagtgcttattgtcgttctttataatct

SEQ ID NO: 138017 - DNA, 1561 bp, Homo sapiens
gatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaattctgagtttttgattaccatctaaagaggagtgagttttaaacactaaactagaattgtaaaattaggattttacattttgaagttataattaaattaatttaaatttcatattgtcctaaggacagtttgatgggacagtttctttaagtatttctggattgggatatattattctaggaatctatacatggtccctcattcttaatgttgttacccattaggtgagtcaaaacaaccaagatgagtagataaatgactgtttgcaacaattgatctacctttcgtcccagacagtgaacattccttgactaggtaatttccttttgataataaaaacttgatttgaaagttaccctggcagattataagttatatgaaactagacagcagctcttttgcaaacatggagtaga

SEQ ID NO: 138018 - DNA, 1460 bp, Homo sapiens
cagctactcagaaggctaagacagaatgatcacttgagcgtgggagtcccagaccagactgggcaacacagtgagaccccatctctaaaaaaatgaaaaaataaaattattaattagtgtctctattcaggagatattttaacttgaggttattctatttccttttgtcataagactaacgggtctctcagtgtttctcactttttgttattgatacccaaagattatcatgtacgtaccaaaatgctcttttatctgttaaaaccaacatactgcttattgattaaaagtaaatcctacttttctttcagagactaatagattggaatatatttttgtttcagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgccta

SEQ ID NO: 138019 - DNA, 1027 bp, Homo sapiens
aaaattgttgaaaagttgagatttatcaataatgtataccccttccttttcactctctgaaagtatagactgccaggccgggcatggtggctcaagcctgtaatcccagcactttgggaggctgaggcaggcggatcatgaggtcaggagatcgagaccatcctggccaacaaggtgaaaccccgtctctactaaaaatacaaaaaattagctgggcgcagtggcgggcgcctgtagtcccagctaccctggaggctgaggtaggagaatggcatgaacccaggaggcggagcttgcagtgagccgagatcgcgccgctgcactccggcctgggcgaaagagcgagactccgtctcaaaaataaaataaaataaaataaaataaaataaaataaaataaaataaaataaaataaaataaaaaaagaaagtatagactgccatggttatttattatactcaacctgctcattttactctccttttatttttctgcagtaatgtgtgtggctggtattggacttgttgtattattcttcagttggatgctctctatttttagatctaaatatcatggctacccatacaggtatgattcttattttttgtttatacagtgattaccaatacctggaatgattagagttgatattgctttataatatccttctttttgctttgcttccaaactattttagcttataaaggaaagatataggctttatttttatttattcatctatttatttattatttatttatttatttatttatttttgagatggagttttgctcttgttgcccagactggagtgcaatggcgcaatctcggctcactgcaacctctgcctcccgggttcaagcgattctcctgcctcagcctcccaagtagttgcgattacaggcgtgtgccagcatgcccggctaattttgtatttttagtagaaacggggtttcaccatgttgatcaggtcttggactcctgacctcaagtgatccacccgcctcatcctcccaaagtgctgggat

SEQ ID NO: 138020 - DNA, 1005 bp, Homo sapiens
gaggtggaggttgtagtgagctgagattgcgtcactgcactccagcctgggtgacagagccagaccctgtctcaaaaaaaaaaaaaagccatttaatatttttaaatgtgtttgaggtcagggcaataactgaatgtccagacaggttatttcaaagtacaatttcgggaaaactcatatttcatctgtaagttatggtgggacatttgtttaaaatatcaatttttctttgcacaaatgaagtaatcttccaattttaattttttgtatcttcatagtaaataattgtcatgccgtatagatacaagattccttattttggttttttataatgaagagttgaaggtttatatattcattttaattttcttcatgagaaactggaaatagtaaaatggtatgtcttttttgtctgtgcgaatttctccttaaacaatttttcttagatggtggagttaccttaggaatggtgcttttatgtgaagctgctacctctgacatggatattggaaagcgaaagagtaagtcaccttactcaaaatgtaacagtgctgcctgtactatggaaaaagagtgatctcttaatcacttttcctcttacttataggataagtaggttattttacccctttactatttttttctttaaatgtcatatctgttattaaactcctttactattttaaaattaatatatgctcattatagaaaatgtaaaaaaacaggagcatgaaacattccaccactgaaaaactaattatttttaaattgtaatatatttctttccacttataaaaaccttaaaaactgtatatataaaattttgacacttcacaccccctttttaaactggagttaaataactaataactttttctatatacataattttaaacttatactctgttattgtttgttttctttaagatagggtctcactctgtcactcaggctggagtgcagtagcataatcatagctcactgcaacctccgcccctaggctca

SEQ ID NO: 138021 - DNA, 1033 bp, Homo sapiens
actgtttcttggccattatcccctttgaatcttactgggaggccctaattagtcttgtccccatatcactgaggtggtactagtttggcagtcacttcataagtagcattaaacagaatcatcttgatgaatgagtgaaattacagaacactctctattaccctattgaattcagcatggaaaccactctttcgaccttaagtccatggattatctagttgtacttggcaaatccttcttaatctaaaagatgttatgttgtggttaaatagaatattgtacctattctatcctattttaggttatattatagactagtttgattgggataacataaaaaggatcatttttccgaaagtaaccacaataattttgattgctttcatttcagattttattttgacccatataattagtaaaaaaattttatactttaacatgtttttctctcctttccattagattagagtgattagacccccaaattatgctggtccccttatgttgggattgcttttggctgttattggtggacttgtgtatcttcgaagaagtaatatggaatttctctttaataaaactggatgggcttttgcagctttggtgagtgaatttcagaagacaaaaaattatttgaataaaattcctaatagtgtatttttaggtaagcttttatttatgtgagaagtagcattttatttcttacctgaggaaaatagttttatatattttaattttctgtcttaaaatcagtttgtttcattcattatctcataaggatggccagaacttcaaggaactgattgtacctgccttttattcaacctaaatgacagactgtcatctctatgaaaatctctagttgttctgaaaatattattcttttttttttttctttgaggcggagtcttggtctgtcacccagactggagtgcagtggcaccatcttggctcactgcaacctctgcttcctgggctcaaatgattctcctgcctcagcctctcgagtagctgggattacaggcgtgtgcca

SEQ ID NO: 138022 - DNA, 1063 bp, Homo sapiens
gagttcaagacctgcctgggcaacatggagaagccccatctctacaaaaaatacaaaaatcagctgagcatggtggaacacgtgtgtattccaagcacttgggaggctgaggtgggaggatcccttgaggccaggaggtcaaggctacagtgagccctcattgtgccactgcactgcagtctggatgacagagcgagacagtgtcattcattcgtttattcattcattcattcattcataattaattacatcaaaagtgtaatgtctgacaaaatattatgaaataatgtattttaagaataattatcatccagcccaactaccaaattttggctttaggtctcacattttctgtatacctctgcttgttagtattggttttaagtaagctgcctcattaaaagaactttaaatgccaagttgagtatattaatagcatgctcactttgtcttttttagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagtatgaactccaactacgctttaaaattaaataactcatataacgttaaccatttctcaatcccagaagggccaagttagtgcagtaggtacttaaataatgtgtataccttactcaggatgtctatggtagcaatactactgctcttttatagtcaattcttgattatccgtatcagtgggggaagcatggataaataattgtggtagccatcataaaagtaacttaaagatcaaacagtcatcttataaattagtatcaacttggcggggcatgggggctcatgcctgtaatcccagcactttgggaggtcgaggcaggtggatcatctgaggtcaggagttcaagaccagcccagccaacatggtgaaaccccatctctactaaaaaaaaaaaaatacaaaaattagctaggcattgtggtgcatgcctgc

SEQ ID NO: 138023 - DNA, 1078 bp, Homo sapiens
tattttttcactttgaagtactttggaggcaggataacggactaaatagctcttatccctcacgcggctaggtcccatttttctagaatattacatgaaggcggcgaatttcaaggacttctaaatgagtctttgaaagattctgttctagcaacttcaagccattttggactccgaaaactccgcaatatttcacaactgcgcatgcgtgcttggaaagcgtcagcgcgctagatgtttacgtatcgagaaaggggcgggtcattatctttagcggaccaatgaaaacgctccagattatcttttttctattggccgaccggggccaattagaaatcaaccttcttttagcgggcgtgtagcgccagcgcgctgtgacgtaatgtgaggggtctcccggcagggctgagctggaccaatgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggaggtgagaacgcggtttccagcagcatgggcttttcccaatgactggggcttaagagggtctgttcgcctcttcccagccccctttccctgccgcttctatgcctttggtggcttcaattacgcggttttcggagttgtggaattcgtgagagaaggaactgtaactctttgtcttctggggatgtagaatctgagagtggagtagcgtaggtgacagcccgacttctacagtcttgtgaatgtgcatagctatgagttttgacacttttgagtgtgggccccgtcaggtgttgggggtggggagttcgactttagatcccaggagtaggatatctgagactctatactgctggccgatgtaactccctgaatgatgtgtaagagttctctattttctagcattttcatttcaggagtgtgagagttagaccaaagagtgaaattatgccagatttattacttt

SEQ ID NO: 138024 - DNA, 2536 bp, Homo sapiens
gccaatagctttccaaagttattttatcacgtatttatctacatattacagaagtttttactgttcttgcaacttttctctaaacttgacgttatttgaaaactaaaagctaagccaattagtatagtagtaatagcagacaaaaaaaatgagagaagtaaaggaagttttgggggaacagaaagaagaaagagctagtgtggagatactaaaccgaagcttgtggaacttgaacgccattttgaagctagttccttagacgattcggtcgaagatctgtctctcggctgccctctatagagctctaaacctggcttcaaggagttctttcattcttcattagataccacccaccatacgtcattttataaagccggaaactacatttcccaaaaggcctttatttttcctcgcgggaaaagggattgcaattactataggttttacaggtatcgcgagatttcgtcaaatctcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaaggtgagcaaaaattatgacaaatcatttacaacaaccttatatcaatgtgtcctcgcggcctctcgtgtgctttccttttacgaacatctcggccttctaatcttgaatgctgtctgtctcccatctcgtcccaagtcattgggatgatgtccttagcattggctttatcacccagtatttctgtttcggtttccagctctctttctgttatcggagtgatagtctagccctgctttttaattcttcagtaacctttgatttcagggaaggacattcttggtagacacctcgttccttaagtgatgtcctacattttagctttggggatatgtttactcctaaccctgtatagaaaaatatcttctccaattcctattactgtaatagacggaaactgtaaatctagctcttcacctggtttaattgcagggaaacaacccaaatggtatcgatgcagctttgaagttatttgtggattaacaatgttagctggccaggcgcggtggctcacacttgtaatcccagcactttgggaggccaaggcgggcggatcccctgaggtcaggagttcgagaccagcctggccaacatagtgaaacgccgtccctactaaaaatacaaaaattagccgggcgtggtggtgggcgcctgtaatcccagctacttgggaggctgaggcaagagaatcgcttgtacccgggaggcggaggttgcagtgagccaagactgctactgcactccagcctgggcaacaagagcgggactccgtctcgaaaacaaaaacaaaacaatgttagctgtcctgaaggcaatcgtggtcatttttttcttatccaaaggttgggcaggtacagggagttttgagaccagcattatgtagagaaaatgcaatagattgaggagaacaaattaattttcatacttgatttgcaccgaaggtgaccttgagtaacgtgggcagttgttacacaatgaaggtgacccgtaattactatttagtttgtttagccatcttttgattttcacttaatagaatcattggaggatattattagattgtgtcctaaactcttaagcaactttgaaaataaccacaaaatattagctggactattttcatattcccaaagtagcatttattatctcttttactttgggcatatgatttagcctctctcaacctcagtttccttctttgtaaaataagtaatttgtaaataatgcctacttcatggggttgttgaggattatatgagatcaccaatgtgtggtaattaaacagttgtcacagaggagaggtctgatgaaatccaccagagttacatgagtgtgttgaagttatgagatgttgcagaattttttggtagtcttaatttctttgctctttgagcaaatagggccaccttgtacctcaggaaaggttttttgtttttttttcagcgtggaattcacatgcccactttttatcttttctggagcagaatatattatgaaatatttgtaaatttgcctatcccggtgtgactaaaagatgaaaagggaaagctatgtaagacagttagaagatctgataatggtctaataactatcatgaagtaacccattgtaccatgtagaaatattcattgctagtgaatgggcaacattgcagtttcttttttttttttttgagacaaagtttcgctcttgttgcccaggctggagtgcagtggctcaatcttggttcactgcaatctccgtctcctaggttcaagtgattctcctgcctcaggctccctagcttttcattatatatgtaagtacctttggaggctctttaaaacgataagaacctgccccttaaattggacaggaagaaaaaaaaaaacagctagaaacaagctttttccagtctcggctgtttcccaa

SEQ ID NO: 138025 - DNA, 1047 bp, Homo sapiens
ttgtatgttgtaagttgttgggctctattgagtaaactttaatgaaaatttaagtcataagtattcaaattaatcaatgggagccaaaatttcaggggttatgcaaataccactttgtagagaatgttactgacatcattcattctttgcttttttcccccaacactattatgaaaactctcagacatactgaagagttggaagaatcgtatgaacacccatatacccaccacaaagattctacagttaacattttgctatttgttttatcatgtatttgtccatctgtcaattcatcttatttttgttgcatttcaaagtacactgctttaatagctacaatatgttttaacattttattgaactacataatactgtaaaattaacttccttggctttcctgattggcagtatcaatcacatatgttttctttacctgacaattgataatatgcttctgtattcttttttcgttttcctgtaagttcgaagcattcagcaaacaatggcaaggcagagccaccagaaacgtacacctgattttcatgacaaatacggtaatgctgtattagctagtggagccactttctgtattgttacatggacatatgtaagtactattgattaataatttctgtttcagatgtttttcattctcagtctatgcattcaaagtgtcttaacatagtagtgtacatatctagttaggagggacttgagagattgtgtaatctaattacccacacagtgcaggggattttttccccccagcattcatccatcttctgttcttaacattcccagtaataaattgcttactggatcacaaggcagccctttccatcttgtgtagctgttttttttgtttttgtttttttttttttttaagaagaagtcttgctgtgtcccccaggctggagtgcagtggtgcgatcttggctcactgcaacctctgcctcctgggttcaagcacttcttctgcctcaggctcccaagtagctgggaccacaggtgtgtgccaccaggcctggctattttttttttttt

SEQ ID NO: 138026 - DNA, 1339 bp, Homo sapiens
gccctggcgggtggatcacctgaggtcaggagtttggtactagcatggtgaaaccccatctctactaaaaatacaaaaattagccgggcgtggtggtgggcacctgtagtcccagctacttgggaggctgaggcaggagaatcgcctgaagttggagggggtggaggttgcagtgagttgagatcgtgccactgtactctagcctgggcgataaagcgagactgtctcaaaaaaaaaaaaagtctcaaaaaaaaaattaaagtgtgcttaattagaaggataaacagatgttgaacaaatgtttgatcagaggagcttttggaggtgaaatgttccttagtgatacagagaatataaaatactctggcagttacttaggtagttgtggttgagggaatcagtgtattgagtgggtagtatagaaatgtgaagtataaatttgaattaaataaaatttaaaaattcatttccttggtgatactagtcatattccaggtggctagtagccacatgtagctagtgactactgtttttaacagtgaagatctagaacatttccttcagctcaagaagttctattgaacaacaggactgctctagaaaattaggacagcaatcaggtttggcctatatggagggtattagatcccaggtgagtttctgtgtatttttaacctatagaacagaatatctgtcattttcaagaaatagtctccgagagagtgtactctggtttaaacacgtaactgacagcattttaattcttacaggtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcattgtaggttttgtttctttgtaaatgaaactaagcttgatcactttagcctttatgttaatattaaagtcaaatgctgtgcagcttcttaaataggtttttttttttttttttttttttttttgggacgaagtctcactttgtcccccaggctggagtgcagtggcaccatctcagctcactgcgacctctgcctcctgagttcaagtgattctcctgtctcagcctcccgagtagccagaactacaggcacatgccatgacgcccagctaattttttttttttttgagacggagtctcactctgttgcccaggctggaatgcaatggcgtgatctcggctcctgcaacctccgcctcccgggttca

SEQ ID NO: 138027 - DNA, 1096 bp, Homo sapiens
tctttcccgtggcggccctgcttccggcaggggcatcacccggaagtgggggtagtcgagggagggaggggtaaaggcggctggccgccgcggcggggggtgggaaaagagaagcagagggaggagttgttgctgccgccgccgcagccgcagctactgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtttcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattgtccgaccctgtggcatcttatctttgacacttttcttcgttgtagacgttgagattatcttaagcacaaacacttatcgtttcacaattcagcgtttgtccaggatctgatctttattttaatcacagactctttatctacaatagtatggctttgtattgagaatatgtgcagaacattgaattagatgatactgaggttattaatttttttttttttttgccgggtgcgggggggtggtggggagggggtgatgcacaagaaataagacagagttcctggcctcaaaagagtttacttacagtaggctgggc

SEQ ID NO: 138028 - DNA, 1085 bp, Homo sapiens
tttagctttgcaggaatggaggaagaggaagacatctatctggactgatagatagaagaaataatgtgagcaaagccatgggggtctggaaagttgcccgacatccagtaacacactgtaagtcaatattcctatttctaacagccacatcttccaagatgtcactgattaaaattagaaaaaatatagaatacaaaactagtcagctcacaaacatatccaactgccctccagccaataagaaagcttatatagagaaaaaaatacatggaaatgacaaaagcaatgttaatgtatgaggcttaattctgatgtaaactcaaatctaaaagagaaaaaatgtaaaactcgctatactttaattctgattgagtgttgtgccttaaatataatttggaatcatttttaaaattgttgggaatgaataacattttctgaagtgagcaactgttccaggttttccccaaggaatctctgcttttccttttttcctctaaattgatttctctctattgatcttcttaacttgataggaactattctattccgatcacagccttagaaagatcttgatgcctgccctcaagataaggttaaacactaatccctccaaaggataggttaacatctctgttctctaaagcagaaggttgattttctttgaaaaatgcttgcagaagcagtaaaatttgcttacaaaacaagagagagagagaaaagagtgcaaaaataaccccagctaacacaccacaaccttcacttctgtgagggcgctaaaggaaatacattttaaaaaaataaattccttgttataactccttttatctatatatttaaaagctcttggcaaactttattaatcaagactttggacatcctgatgagtgaaaataatcttcatttgccagttgggaaagtaaattgcaaggagagatttttgtctgaactcatagaagcactagcatagatgagaatagtatttgggagttttgtctcaaaattccttctattcatctttgttaaagggcagttcaggttttagcgttttgtttttagacaacgatatttcttaggatatagctcaa

SEQ ID NO: 138029 - DNA, 1872 bp, Homo sapiens
ccgcttcagcctcccaaagtgctgggattacaggtttgagctaccgctcccggccctgccaccacgcccggcacaatacttaatttctaacttacaccatagaaaattggccggtgcggtggctcacgcctgtaatctcagcactttgggaggctgaggtgggtagattgcttgaattcaggagttccagaccagcctgggcaacaaggtgaaaccccatctctacaaaaattacaaaaaatagccaggtgtggtggcatgcgcctatagtcccagctactggggaggctaaagtgggggaattgcttgagcctgggaggttgaggctgcaatgagctgagatcatgccactgcagtccagcctgggtgacagagtgagaccctgtctcaaaaaaaaaaaaaaaaagaaaaaaaaagagaaagaaaatggaaaactcagattgagagggtcccccagtagcctatagtacacctacatatgctaacatggcatcttaaagctcattattacagctggcaaatcaaatcactgtgatgtgctcatcctatttccctatcaagaaaactcataacaatctgcttctgtaattagtgagccacagactctaggccatcgagattttccacattccctaattgtcaaatgctgaaccatacttgtactgaataagttgtgatacagtgtaagcaagggaaaaggccttatgtatgtctaacctactctgcaaatagctgcattcttacaaagttgtgtgtaaattgaatttttacaaagcatgtcagcactttgattagtacatttttattgtgtgcttattgcatattcagtgtttcctgtgagctatacaaagaagcataaggcatatgttccaatgtctagcaagagaaagaagtttaataccaagcagagagaaattaggtactactaaactatgaaactgattccagggtattcggaatttaaaaagaaagtggctaggagtatttgacatgatttttcatgaaggaggtgggacttcagttcatttacttactcaacagtgatttattgagtagccaccatgttcactggtggtatgatagtgaacagagcagatatggtcctgtttctgtggagtttacagactagtgaagtaatagaacttaaatatgtgcaagaaaacattctaggtgaggggaccagttctaaacaaagtcatagaaataaatgataagagcatggactatatggcaatcagtgaagggacttgcttgattgtagtagagattttatgttggggaggagcactgcaagtgatagatgcagaccatcttttgaatgctttgaagaactatttaagtctgtctaaaagtcctttggatacactgttctggagagggtttggggctttggggtcatactgccttggtttgatctcatctctactctaatttgtttaagtttagaattttatagtaagttttctcagtgacacaactctataggcaacaaactgatatttacagagtggttggggtcagtaacccttgtatcagttaagcaatgtacacatgaagtgccagtaggaagtccaaggaaaggttgggagaaataaaaggaggttagtaaaggaaagagaaataaatacattctgtgatagttggtagaatgtcatcagaaatgtcttcaagcaaaacaatacatttgcctgtcttttgtttctagttgcgtttaatggtagtgtgttttccttgtctaaatatgagaaagagaaactaaactgcagctacttgacgtgggcatctgagagctaccaatggttggcttaggttatgttctacatttgaagcatctggtcagttttagattgtcttctatatttgaagcatctg

SEQ ID NO: 138030 - DNA, 1193 bp, Homo sapiens
aaaaattaaaaaaccccacaaacagataaaagataaacaagaaacttaaaaaagactaacaatatgtgacaggtaaatgatgaatatctttaatatgcaaagatctcttacctatctgtaacaaaaaaggtaaacacccaaaataaaaatgcacaatggaagtaaacaggcagttcacaaatgaagaatacaaatggtcaaaaaatctcacaaagttattggagataaaaaacagatgatcatttttcacataacagattgacaaagcttaaaaagaattttcatagtacctgataaaagtgtggctagacactttcctatactgctagtgtaagtgtgaaatgatatctttccagagggtaatttacagtatgtatcacaagccttaagaagtactatttatatttagaacatgtggaaaaataaaaaataaataagtactatttatatatgttgttagtgggtatataaattgatacagtttttctggagggcagtttggaactatttatcaaagtttagaatgtacatgccctttgtcctagcaataacacttccaggaattttatctaaaagatatgctcatgaagatgtatatacaaggatattcattgaagcagggtttataatagcacaaaactgaaaacaacctaaatgttaatcaaaaaggaactaattaaataaaatatagcatatccacataagggaatattacaaccattttataaaatggtacgtttatctatcttctttggggatagttcagttttgttttttattgtggaggtctatatgtccttaaaatttttttttctttttaataattagagatgaggtctcactatgttgcccaggctggtcttgaactcctggcctcaagtgatccttggcttctcaaagtgctgcgattacaggcatgagtcactgcacctggcaggaggtttatatgtcttgatacaaggtgtaaaagatatgttaaatggaaaatgcaaggtgcaaaatagtacatatagtatgatcccatgtgtgtaaagaagaaaaaatagggaagatgggcattacagaggctttaaaatgcactgggaataataaagttttcatttttatctttagagtatagttcatgagtgaattcttttccattttttttcccagttatcttaaaagctctgttgattgtggatctgagaact

SEQ ID NO: 138031 - DNA, 1104 bp, Homo sapiens
ttcaaaattagggacaagatggattctttctaattatcagaagctcatcatatttttaagggcgtgaatgattacattggaactagaatattttgtgtctccagatcagatacttgtgagagctctactttttaactattcttgatctaaacattaacttttaccatttatttttcagaggtttcaaaatggttttggctctttagtgaaatacagaatttatactttatctctgcagtattcttacctaaaattctgatttattataagatcttgagtagattggtttcagtttgccttgtttttattacccaaaattggctaattagcccatcattactctctatgaagtctgatacatttccttaattcaagagtcctatgaagtgtggtgctaatatgtggacaattcttctcttcctaatctgaaactgtaggtgattttttccatgtctaagttttatagtcatcttggccagagagtaaactttggatccatattactatttgtatgagggaaaaagcagtatttcttgtttgttgactctacactctgattagctaagactatgttgatagctgtggctagaaaagttttatttacatagcatatattccttctcctaagttttctgtactgttgacatccatgtgactacttagatatgaactttccattttcacatgctccaaaggtagattttttttttcttgtattcaccatctaccttggcgtaattccagtcttagaggctcccacattgcttcttcccggcaacatccccgaacagggatacggttgcctttaatgatctttggggaaagagccaagttggaaaagctgagagatgacaggtaattattttacgtatttatcttcaaaatattcaaatttatataaaaatattttcccctaatcatatctatgcaaaagttaggcatattttgcagtttgttgattagtaaagagaatagtaaaagtagctctgcaaactcaatgctaatgctttaaaaatgagttgcttaatttcactgagtaataagtatgacacatgaatttgatttatcctcagatgaaactaattaaacctcctccacttgatc

SEQ ID NO: 138032 - DNA, 1067 bp, Homo sapiens
tgcatatataactttaccattcttgtaggtacacaagacattttatgtttctttctaacaagaagagtaaaaatgaaaactaatagggaaactccattagattgagttgtctcactcttcttgaatgtggtgtgatgattattattttaaatcctgtgtgatagaatttaattaaactgacttttggaatttccttccaaaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgattgttttgtaaggcttaggtgtctgttttgatcttttaactttttgctttcttcttaagcatgagttttgaatccatgagactagagtgcttgctgtatcattgaggtacagcatattcccaggattaaaagttaatgattataattaaaggttacataaaccttgaactgaagaaaaggcagctgggttggcaattcatggaattcaaggttcttaacacaacatgactagggtactctttacctctaatatattttacttaggcatggagaaacttggagaccatagctacagtggtcatatctcttacttgtttctagtctatgccaataacattttctgaaaagaaaaaaa

SEQ ID NO: 138033 - DNA, 1056 bp, Homo sapiens
aaatcagcacactgcaatgctgttttgcaaattgctttttgttccacttaatatactgtgaattgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatcttttttgttctcttacatgttttgtaactatgttatgattcttggtaaggcctcataaagattttcagtaatgtgtgggacaaccccgatgtcctggaagccttagtgttttgctgccttagataaagttcctctcttgtttacctcatgatcacatttgtatatctatgaaattcgttaaaaaaaaatagcagaaagaaatacacgagattactattttttatagatcaatcatggttgtgttggattttaaggaacataattttttttttttttttgagaccgagtcttgctctgtcgcccaggctggagtggagtggcgcgatctcggctcactgcaacctctgcctcctgggttcaagcgatccttctg

SEQ ID NO: 138034 - DNA, 1016 bp, Homo sapiens
gtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagttctaattgtttggggtcaagactggtataaaagttaaatttctccagattcaaatcctttaatacttaagagaaatcctttcatacttgataatactaagaagtaattataacattactctttttaaaaagaatgttatctgtattgtttttcttatcaatgctcttaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtaagtaagattttttgtgtgattaataaaacttccagaaaaaaaacttggtaaggttcagagaagagttgtgaagataattaaaggtggggaaaatattatgaaaattaaggaaactggaaaatggaaggataaggtatgatctaatggtactcttcaagcatggaatttaaaaagataattgtcgtatctctgttaaccaaaaaagaattgggtatgaatgaataaatgaaaattaacatttaaaatataatatgattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggag

SEQ ID NO: 138035 - DNA, 1096 bp, Homo sapiens
agtgacaggaatttggagacttttaatgagatcctcttctatctgggaccatatatttgttcaatgtggtataaaaatggtatcctaatgatcatatctaaagcatactagtagtgcaattaagatcttgtgtggcaaacccatgagtccttttagtaaaaagtggtaactcgggctgggcatggtggatcacttgaggtcaggagttcgagaccagcctggccaacatggtgaaaccccctgtctctacaaaaaagataaaaaattagccaggcatggtagaacatgcctgtaaccccagctacttgagaggctgaggcagaagaatcacttgaacctggaaggcggaggttgcagtgagccgagatcgcaccactgcattccagcctgggcgacagagcgagagactctgtctcaaaaaaaaaaaaaaaaaagtggtaactcatgtttaatggtggaaaaagtatattcctgaagaacaaatgctttgtctttaacaggtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgc

SEQ ID NO: 138036 - DNA, 1045 bp, Homo sapiens
tagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacagg

SEQ ID NO: 138037 - DNA, 1026 bp, Homo sapiens
tcttaaaaaaaaaaaaaaaaaaaaggaagaaatatctgattttccttgtattatggaatatccattggatcatagatgatagccccacaggcttgtgcagcaatttgaatacctccctctgcatgtacatctattgaaatacaaacacgattgttttggcttaatctccctttagtgtttatggattagctaaaagccaaagaaagtgactattgatactttaagttattgagatatatatgtgaatttcagcattttttaaaattcaatgattatcattcctatattgcagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaaggtaaagtaagaaagggtgacatttgttaaaatgttgggtggataaatgaccttagtattttttaggccaatcattggaaatacatgcttttatgtagttaaccatttactgaaagacgtattttcattttggcaatattttaagttaaatatcagtttagaagatttaccaaatatggaattaatactgtagatagtacagtatgtctgtttattttaagagagacaaatgagaaatacttatcacttatttacttacattattaattgaaaaattgacatgaccacatggtttaaaataatgatagaaaaaattcacccatattcccttgctataatgtaaatcattttctaattccattctacatacctttctacttaacagagttgcaaatgtagtattcatactactttgtacccttaacactataaagtttttcaccatttttgcagtctagattattatctaatatttctgactaagtctgtcacatcagtttg

SEQ ID NO: 138038 - DNA, 1062 bp, Homo sapiens
gggaggccgaggtgggtggatcacgaggtcaggagtttgagaccggcctggccaacatggtgaaccccatctctactaaaaatacaaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataaataaataaataataaaatattttgtgtacttcgtctttctgaagtgaaacattttctagtgaaacattttgaagtgaaacattcaaacattttgaagtgaaacattttcatattaatttttaaacaaattaatattcctaaagctgtcttttgggtaaatgctaaagattgtatttttattttagttaagacctgaactttttcttccttagcattttcaatgtgtttgttttaatttatagggcaaaacatcagaggctcttgcaaagttaatttcactacaagctacagaagcaactattgtaactcttgattctgataatatcctcctcaggtatttatcttcactcttccctcttctctttttttaacttcttaagaaaaatttcaaatatatacagaagtagaaaaaggactatcatgaattcacataatctgtctcccagatataaaaattatccacattttgccatacttcatctatccattttgtctgtctttcttgttgcagtagtattaaaccaaatttcagtcatattgttttacggctaaatattctgtgttatctctaaaaaaggatatattctgatataactatactaccgtactgtacctaacaaaatgaacattaattccttaatgtcacctaagacccaattcatattcacatttctcctgttgtctccaaaatgttttaagtctctttgcctgaaatagaattcaaacaagatccatgcatcatagcatttgactatcatatggcttatgttcttttaatctaaaacagcgcctctcttctttctcctca

SEQ ID NO: 138039 - DNA, 1790 bp, Homo sapiens
gtttctcaataggggtgctattgccagtttggatggggcaattcttagttctcggggactctcttacatactgtagtacaattcagtgcccctgaccctggcactggcacactaaatcgaagtagtagcacccccttccccatcccgtgcagtcattattacaaacgaaaactccctcccacatttctaaatgttccttgagaacaggttaagaaccaatgttctaggactagggtgaaactctaaaagtatctgccaacaagagctaccatacaggtttttccagttcaaggtttatattcctggcattggcctagaactgatataaggaaaaagggaaagcaactttcacctaggcatttgttcagattctattttatatctagatatttttgacaagtaacaaataatgatatgtttcatgatagtgatcatttatgctccttaaatctatctttactctccatacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggtaacttaactccctaggagaaacacaaactattttctttaaagccttctcagtataaatcttcacctagtttttacgttttccaataaaaattttagttgcattaatatggagttcgtttgtttttgttttgagatagggtctcactctgttgcacaggctggagtgcagtggcaccatcatggctcactgcacccttgacctcctaagttcaagcgatccttctgcctcagcctcccgagtagctgggactgtgtgtgggcacatgccaccacacccagctaattaaaaaaatttttttttatagaaacagggtctccctaagttgcccaggatggtctcgaactcctggactcaagctatcatcctgccttagtctctcaaagtgttgggattacaggtgtgagccaccacacctggccattaacatgaagtttgttaaaatatttctatttgtgctaactactaaatatactctgcattcagtatcagaaaagactttgatatgcttcttcttcttattattgttgttatttttaattctaggctcctatccagcagtttgcagacaaactcagtggctattttgttccttttattgtttttgtttccattgccaccctcttggtatggattgtaattggatttctgaattttgaaattgtggaaacctactttcctgtaagtgacttgtaataactcgttactatatgcagaacaatttgtgagtcttttgcattagtaattcattggaaataactttaataattaccaggatctttaaaggtttggagtgggagagtgataagaataatatttgcatttttataaatataaaaaatttccttttggaaaaaaaattttattatgactggtgattttccaaaagcaaataccaaacttttacatgttatgcttagtctcatttctgacatggttttgctttcacagaggactatagatatattgaggaaaacctcaggatttcagctctgtcatttactgtcaatatgatcttagactacttaattgctctctgagcttcagtttcctcaactataaagtgaggttttaataatacccattttgtgtaacttaaggttgttgtgaaggttaaataatatattagaaataatttgtaacttattaaatgctttacaaata

SEQ ID NO: 138040 - DNA, 1009 bp, Homo sapiens
attcattatattgaaagcctttcttttttaccttgaggcactagaggcgtctcttaattacctattaacagtcaacccttaaaaattagctctagttgtttaacatatattcacagttatttagcatgaacaaacagttcagcattggcagaggagagctgttgtgtataactaagagtatttcttcttttattttcccgaagaccatcagttttttaagtcaaattaagtcaaaggtcagtttactaagaaactaaatagtcatctctttgtcaaaacagaccttttttcttatttctggaaaggtgatgtggaggatcatcaagtcattgtatcttaatttttttacaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggtacatttttttcctcttgtttattagtgtagtcatctcctgtaggaattccccggatcaaatctagtctggtgtttgactgtgatttgcatatatagttggtatgaggctaaaaagacttgtattttctcatttaattgtatgtaacttatttcttcatacagacaagtatacagatgaaaacaaatgaactataatcctatcacacagataactcctgttgacataaaaaattaaaatagaagttatacatatttgtggtaggacaattcagatagttcagagaattacataatgaaaattgtaaacctcattccctgcccccttccataattcctctctccaaagtttaacaactgttaacctattaacagtcttttaaaatgacagctttattgagatataattcatatactataaagttcacctttttaaagtgtacaattcaataattttagtatagtcataaaggtgt

SEQ ID NO: 138041 - DNA, 1034 bp, Homo sapiens
aatggggtaggttcacaagaacatgggaagatatgaattggagacagccaatagagatacttttggaaagttttgctatgtacagaagcagataaatgtggtagctagagaggtgggtgagatcaagaaaggttttttttttttttttttttttttttaagataggacaatgtacagcagagaaaagttgtgcaggagtgggcggggagaattgttgggttggagagatgttctagaataggcaaaggagcgggggtgtctagtgcacaagtagaaaggttggccttaaattaggagcagaatcagtttataataacagaagggaagctagatacacagacacaggaggcacaggtagttgagtggatgcggcaatgagagctgtggaagttcttttctgattgcttctattttctttctgaagtaggaagcagagtcatcatatggtattaggatggggcaggagaagttggagatttgaagggagatgagaaggtatgaaatagccacctagaagaaatggagaatgaatggactagggaaatatagttaagttgccagatagcactaagagcccacttaaagaaaatgagatgtcagcatgattgtacatgttcatctagccacattcagctactgatgcacagtaagtatttttaaatttgattgaatttttatggaaggtcaaagggaaagcctcaccaagaaagtaatatttgaactggctcttgaagaatgtgattgagtttgctgtctggagaggagggataaggacatttcagatgaaggcagcaatgtgtgcaaaggcccagaggcatggaagaacagagtatgttcttagaaaatttgaacatcactgttggaggctatgttctaggagcaatacaatgtagtgactgtgcaaggttagacaggaagaacttgcttcatggggttttataaagattaattgaacttactaaatgttatttctgtgcctactttcagatgctcttaatgctcagcagtataaagtcctcattggtaaccgggag

SEQ ID NO: 138042 - DNA, 1157 bp, Homo sapiens
tatgtttcacgtactcattattttttaaatgaattgagtttattttcatcacataggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataagggtaagtgccatggcttgacctttgaggagtatgagactgccctatgtggtcaatgataatgtcataaagtatattgagcataacaattctgtcttaagttccatgctatcagccattaagagtttaagaatatggagtgggattatgggaagtcatgctaatttaccccctgactttctcaacccagctcataagcaagtgagaattataagtttctgaagtgaagaagaagatttaagaatggattcggaataaaatgatcttcaacaaatagttgctgagattattttaagtagatttaatcatagtaccagcatacacccctaaaagtgttttcagaaccctgaggaaaatttttgaaaaacaccttcggaagctgagtctaagttttagcattatctgagatttgtaattaattcacatattaccctaaggtagacgtaatcttcaacatacacagtatcaaatgtaaaagttactggttaagttagagtctcttactaatatcacaaatatttctgttcttagaatgatcttctggatgtagtggcaagtattgacttatcaagagagacagtcaagaggattcggataaattttgtctttgctctaatttataatctggttggaattcccatagctgctggtatgtgactcttaactagtactgctttttccactaaagttattagagacctaacatattggaagcctgtcttcttactattagttttgagcttagtttttgtttgtagcctactggtatggtgagaggtaatgttaaaatcaatcattttaattttcagtaatgtttgttatagcttaagaatatataagcattctgacagatttatttttttccctccaacttttttttttttttttttgagacagagt

SEQ ID NO: 138043 - DNA, 1086 bp, Homo sapiens
cacctgtaatcccagcactttgggaggctgaggtgggcggatcacctgaggttgggagttcaagaccagcctgaccaacatggagaaaccccgtctctactaaaaatacaaaattagccgggcgtggtggcacatgcatgtaatcccagctactcgggagacggaggcagtagactcgcttgaacccaagaggtggaggttgtggtgagccaagatcgcgccatcgcacttcagcctgggcaacaagagcgaaactccgtctccaaaaaaaaaaaaaaaaaaaattcatacctccaaaaacattgaaaaaaatggtacaataaaaatctgtatgcctttcacctaaactcaccaactgatggtattttgccacattgcttcatctctttctgcatatatttgcacagagatatgtatttgtttgcttattaatttttttctaaatagatttacctttaatctgactacccaaacccaacactgtttgcaagattaattcatggagcaaatgatttttaaagaattatacaagtattttcctctagtcttttttttactctacatcagtttttgtcttgttacatagttgtgattgtagcttatggagaattttctgctcttcacttaatattctattatagtcagctggtattttttttaggttgagagaccagatgacagagagagtgaacaaagcaatataactgagaaaaaagaatttagagttatttaataagcatctgagaatctcctaaacttagggacctggtaggagttagtaatgatgacataaaagaaataagtattgttttcttcttgttctctctggtttgagggccaaggaaagacaagaaatgacatgagaacaattacaaaactgtttatcagcaaggacacacaaatactgagagaacaaagaacaaaagaacaatctaagtccagtaagattaattcatggagcaagtgatttttaaataattatacaagtaatatatgatcaccatagaaaaagtagaaaaatataaagaagcacataaaaagttaaaagtatgagtctatttcatcctcatcatgtgagcaaacatt

SEQ ID NO: 138044 - DNA, 2478 bp, Homo sapiens
aaaaaagaaaagaattattattagctaacagtaataattagctatgtaattgttacttcgtgtactttatgcatagcaaccacaagcactgagtgggataaaatatagtgcactaattctgagaagtagggtttctgatgatataactccacacaattcgtttcaagctattttcctaccagtgatcacctttatacatttcataccaaaactaagtgtggatgagcaaatcttctttcttttctgcatgtagcgagcatctcatttacttttggttatttgaaactagcatacttttgcatatgtccagttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatca

SEQ ID NO: 138045 - DNA, 1703 bp, Homo sapiens
aactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaatatttttgtctgtctcttttgttaaatcatccaaccccctctatcagcagttctgaactacctttgttatatttttatttttttcaacttttcatctatgatggaggtggattataggcatcactacactttcggttaggatgggagggaagaaatctattttccttcggactccactacacctgccatatcattcagtgaggatgagaaataaaggaaggaatattattgttctgctttcctttgtagtctctaatacattcttgatagaatgtctactccaaatgagctaaacagagaaaagagattttcttgccattggggagccctatacagagtgtttgaagttcccacccaagatacattcccatacccgaacactcctttttgagttaaggaaaccattgtaaacttgtgag

SEQ ID NO: 138046 - DNA, 1023 bp, Homo sapiens
accctgggtctcgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgaggtaattctgcacgtttgcccgcgtgctctctgtgctctgtcgcaaacctctttggccggagccgacttgttctctcgtctgctctaagttcttttagcttttggctgggccccaggggtcctaggcttggagggcgaggctgctcacgggtttggtggtttctagccgcattttccccagcccagaaagcacccgaagtcacccttcggggatggatcccactgaggaagggctgagattgccgctgggacccattttgtcctttttcctattggtgaaatgcagttccgttgcctccagctcccagtcggcgagatgggacttaatgcttatcctgcaaatctctaggcttcaaggaagggaccttgaaaggtcattttactttcccttcccccacgctcctagaccgtcgcagccaaatgagaaacggcccacatctcacaggttcctgcacaaaaggatatttttccaagaggatgttgatttaacttcaggagtagacccccccgccccccgccactaaaga

SEQ ID NO: 138047 - DNA, 1041 bp, Homo sapiens
catcaggattgtgacatactaggtaatggtagagcagggtgtggctgctcatacttgctggcctccaatctcatccccacgtgtggctagaaaagtagaattttaaaattgggggaagtttcctcgtgcactttgggtctcttactctgcgcatgtggatctctagtcacttgccaacacggtttctctcttatctgccagaattgttggtagagtgggcagcttttacatttatcctttttgtcacgtgtgatatatttgtgcataccaggagcaaggtgcaggaggatgagtcggtatgtaactgatggacttgactgttcatataccttaacaggatccaagagtggtgtttttgaggggtcataaaggtttctgttgatagcattttgcaaccttgacctttttgggaagtggttgattgatgggtaggtatttatttggctggtgtaatctagccccttttccaatttgggctggttcaaatgagggcttgtgttggatattaacagacacgtaagtcagtaggagatctccctttactctaactttaaacatatgaggacacgtttgagttagggaactgtatgggtaccctaaaaggacatgtagctctcctcttctctctaatttcactttggtcaatatttttgcaggtaaccgctgccctgctgtggagatagaagaacccaataatttatgtccatgaaaaatacctggtttccacatttccccaaatgacataggcctttgtaatctggacaaagtaggagtcacagccatgttagtactagaggagtgccctttctggccctcatacaatcctaaaaaaaggggatagaccctgtaaaaaacaggacaggtggacattggcatgcaactagcttttaggttttaattagttccttgcatctcccctgtgttcgacgctgattcttccagatgcatggaccaactaacagacaaggagtgggacattatgctgataaccttcctgtaattgcagtcttgggctttatttcctctctctctagggaaact

SEQ ID NO: 138048 - DNA, 1064 bp, Homo sapiens
aggtgcttaggcagccatgtggtgtcagctcaattcctttttgtttcaacgtggtggttgctggcggtgtttccggaatggggcttcctgagtagtggctgcctcatttgtcgtctttgtcctgcagaagtgaactatggtatttgctgactcttctggtccactggtttggattgccaagggaaattgatttgttgaggtaacatgggatagccagaaacctctgacttgttaattaccaggttccatcttagttttttaggactccgcagttgactttacagcctctttgaatacacttctgcttatttttgtggtaatttcctttctttctctcataggttgccagtcatcctttgcctgcttgtaaagcacttcctttttgcttgctcctgcctttttttttaaaccttactggttttctccaacttgtaacttgtaaagaaactgctttgatgtagtgggaagagaaacaggaaaaaattgagagcagagaaaaagtcactaagacacccacaatatcccagttttccatctggggcagtgaagcattgatggacatggttcctttgagagtttttaatggaactggacctgggacctgagatttcaggtgatagagacttgatattcttattccagctaaatcagtatattttttaatgttttattttgaaataaagattcatgggaggttacaaagttagagaggtcttgtgttcaacccattttcccccaatggatgcatcttacctaattatagaacaatatcaaaagtaggaaattgacattggtataaagtgtgtatggttctatgccattttattacgtgcgtagatttgtgtaaccgccaccacaatcaagatacagaactattagatcaccaccaagatctccttcatgctacctctttataataataaccaccccccttcctgactcctggtaactactgatctgtccactgtttctaaaattttgtcacttcaaaaatactatacagattgaatcacatggtatataaccttttgggattaacttttttcacttagcataatgtcctc

SEQ ID NO: 138049 - DNA, 1021 bp, Homo sapiens
ctgggcatggtggtgcattcctgtagttccagctacttgggaggctgaggtaggaagatgacctaagcccctggggaggttgaagctgcagtgagctgagattgtgcctctccactccagcctgttgggtgacagagtgagaccctgtctcaacaaaaaaaggaaaagaaaaaaaaaattctagacttctagagtggggcaggtgttcagcataaatcaccatgtttgtatagacggtctaggaagagtgaatagcccttgttggtcttgtcagttaactttgaaagccaagttcccagataccagccaggatctaatcttgcagacaggtccttctgtagatagtagcctcaggcctgctgtgttaactcttgtctgtgaaaggggcagatacataatgagattgtacaatcctaggtggagggttggcattgcatttaacttcttaaggaccaccattgaattactgatagtagatttgaaggaacttggagaagaaaaggagctttatgctttatgaggttatcaataagctagttcccactaatttctaggagtaacttcattctgtttgttgtctctctttggttgcaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaagtaagtgccaggctctggtgctggtagactttgtggcgggggaagttgtcaagcacgttgttactggtttttaactttcatactgctcaagtgtcttcatctcttcctcttctcagggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggtaggacctg

SEQ ID NO: 138050 - DNA, 1422 bp, Homo sapiens
tttctgtttttgtttttctctataggttaaagccgagccagccaaaatagaagctttccgagcttcactttccaagctaggggatgtctatgtcaatgatgcttttggcactgctcacagagcccacaggtaccaagaaccttgtagactaccacactgagaacagtattcctatttacttgagtagcccaagctctgggttgtttttggagagttttgtattatactgtaatcctttcagcttctctaattggaactgccactatggctcttgttgagtagctctcatccaaagaggaaataaaggtaaaaaaatgttggtaattgtagggctttttgtggagtttcaggaagaggttgctctttctcaccttagatattttgtacagagttatccttttatgaacgttataagatcagactctcatgctgtcagtaggaagcaaattgaggaatcctcttctgctatcatcaaccggccaattacttactgtgatttgccctttggcctgcctgaagagtgttaactgggtatcttaaattctacctaagttcattacttttttactctttccctttgaccttgcactattagttaaaaatcttatcttgtacctaagtgttttttgttgcaatgtagggatgaaaaccatgatttcttgcagtccagaagtagaaatattttagtgataaggagctggcctctaggactaggaggaatgatagggattgactagaatctgaatgtctttgatcttttctagctccatggtaggagtcaatctgccacagaaggctggtgggtttttgatgaagaaggagctgaactactttgcaaaggccttggagagcccagagcgacccttcctggccatcctgggcgggtatgaagaactctttaagatcatgctttaagtattgtttgcctggtagtaggccataacttgggtggtttattgtcatatagctcagtcacactgggtaactgaggagaatttaataaaggaactacaggctgggcatggtggctcacacctgtaatcccagcacattgggagggcccaggcaggaagattgcttgagcccaggagtttgagatgggcccagacaacaaagtgagatctcatgtctacaaaaaaaaattagctgggcggtggtggtatgcacctgtggtcccagttaccagagaggctgaggtgggaggatcacttgagcctgggaggtagaggctgcagtgcactgtgatcacgccactgcactccagcctgggtgacagagcaagaccgtttctaaataaataaataaataaataaataaacaaacaaacgaacgaactacatacagaggtgtgggtagggttcagggaaaccacaaagggacagtacagtaatttggggctaccaacaggcatcaccatttcta

SEQ ID NO: 138051 - DNA, 1045 bp, Homo sapiens
gggtatttgaatgggaagcttttgcccggggaaccaaagctctcatggatgaggtggtgaaagccacttctaggggctgcatcaccatcataggtaagcggtcctatacaaagctaatacccatataagctggcagaattctgatcagaggaaggtggaatggagaacttcttctatgtctctttattctgggtaaatgttaagaggtaaacaggtaggtaatttacagaggagcctcttggtaagatagagttgggggtttatcagctaccttttgggttggggagcacactgccttacagttttggtgccaatcccttttttttcttttctctcttttccctttttacctggctttcattcaacaggtggtggagacactgccacttgctgtgccaaatggaacacggaggataaagtcagccatgtgagcactgggggtggtgccagtttggagctcctggaaggtgagggtcttctgttttttggcttgtttgggataagggtggactgtgcagtgagaggtgggtagaatggagtggagaaagttagaaggtagtgttgtcattagcagtcattactacctgggcagtacagaggaacttcagataaagctcctggcatccactgaggcggggagggacagatagaaacttggtctgagagttatggtctagtagacctggaatccacaatgtaaaagttggccagctcctggccatatatcctaaaaaagagctggcatgttattgggaagataaagtgggggaaatctggcttactgggccctatagtaatgctgtctatgtatgtgtgctctctcaaaaacaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgca

SEQ ID NO: 138052 - DNA, 1344 bp, Homo sapiens
cagttaaaactgttagatctctttagtaaacatacaaatgtgtttttcagtaggcttcaattacaaacagttaagtacttgtttcttaatagtttcattaatgttgagtcctaatatggcaattctgtttttgagacacttttctgccttctatcactgatagtagcatttaagtttcagattctacagcctagtcagcagatttatctttgacagcataatttctgatctacatttaaatactactttattttataaggtaatatagttacttactgtcactagctaatttttttttttttaccaaatctctcaatataggaaacattttttggaaaggatggatttagaggagagattctaaatccattttggatgtatttgtttctttgacttccttaacttccaaactcaactccctttctagatcccattcattttctgcacctcccccataggcttgtttctctccattgctattaaatgtagaaggccatacctggaattttaaaaatattattcctggtaatacagctcagtgtcattttcctatttttaaaacatgctctacatgcctaatgttttgtgattcactttaacctgatggtttgcatttgctgtttttcactcttatgtcagagcagttgggttttaccccttagtttttatgcctgttaagctttactgtgcttttgacaggtagttttgggtcagttatattcagttttagtattgtattccaagttgataactcttccatgtttcacatttctaaatttaacagagatgctgtagcttaaaacatgttttgataagtaattacactggacctaggcaaaaccactgaagaacaagtgttcctttttaccacatacatattatgttttgatcactgctgcttgagccccgctattggtataattcagatcattttagcttgttgctgaggatgtcacatataagacaggatcaaacctgaaagacactaatggttcatcctctataaggccaacaaagaaaacaaattaatgtgatgtaacttgcatttatgtgcactctgcataggtttcccaataatactgtaatgttgctgaacacctttccctgttttccatttatacacatattaaagtcatattgggaaagatggcaaagcttttgagaatataaacacacctgttttgtttttcttaagttcaacatacttttgtagaatttgtaaaataaatgttcgtatcataattgagaatttatagccaaggatcctcaaaacagaagtttcatcttaggatagtgtttgatatatctaagaaagtccagtaacagagaagaaatgtctcaaat

SEQ ID NO: 138053 - DNA, 1049 bp, Homo sapiens
tcattcattcatacattcaacaagtatttactcagtgtctagcatgtaccagccctctactggacacttaggatacaacaatatgtagaaggggtgattatacagacaccccccccccccacacacacactctatagataggtagacagcaaatatatagcatatagacttgtttcagtagtaatataaaataaatacttgcttcatataagctttattattatttcaatgagatgactgttttatgccaattattttgtatcctaaagggattttgagctgtctcaagaatttctaaaaacattatcacctagcaatggatttcatattgctgctatacaaaatttgtcatgaattcatatttattattttcccattattaaaagtaaattaccattctaggacttgaaagccacatttctagaactaagcattagttataataatttcagataaacaaaagaattacaacattaaaagtctccattctgtgttgtattttagatactatgcaatcatatgtttaagataataaaaatacatagtatgaaagtagggcatcacatgagtattattgggtccttctttataatatactgttttctaaaaaccactttagtataatttatggaaagccttaaatgaaaatttaagttttattaggcaatgtcactataagaaatatattttatgttccagaataaactttttattacccaatatatgaccatgatgggtgagaaacaatagataagtaaaggtacaattataccagaaggctggtatgatagttgattttccttagcagtaggaattaccaatattttttataatttaaatttaaaccatgccttggttattttcccattggttgtgatgaattttcatcaactcatctacactctgactcatgtttgtgagttaacaacacatattttcaaaatagctgactattattaaagcttggagctggttttgactgtgcaaagttaactgactcctgtaaaggactttgtttaatgttattacagtatttattaaaataattc

SEQ ID NO: 138054 - DNA, 1027 bp, Homo sapiens
gtactgaacaaggatcttcgtgatgaatggtaaaaaacgagaatttccattgttttggcaataatattgtttccgtggaagacatacaggattttcaggctgctgtttcatgtaaacacagttgttctaaagagctaatttaaaatcacagtgtagaacaatttagaaagtatgtcgactagctttgtatttctttggtttacagtttattgtgcgctaacgtggcttgtattatgatgaggtttcttctagtaaaactatacatgacatgtctttgatgcttaattgatttatggagaatgtgacatttgctatattgaataattcatgaacttgcccataaaggaagaatcatgtttgaatgaaaaactctgtcataaactgaatttgcaattatatgtgaaattaattgctgtttgccatacaaatgcatcaatgtgtcatctttaaactctcttcttgtaaattttaaatattttcagtaaaaaggtcttattgagttgctaaatacagtatttcagttaccttttaaaaggaaattcagcaatgtaatttatcattatttcagtgtggaaaagaccagacaaattcaaaggttagaatatttcagagcttggtggggttattcactttgctaccttacaaaattataccatctttctttatcttgactaacataaagacaataataataacctgagatccagattacccaatggctttgcaacacgtttatttttcagaacaaaattcccaacatcatatcccatcaacatagattataaaaccttttgccttgtcacagatgaaaagttgcactcttgccaagaaggatgagttcacctgataaacttgatggcatctacattctaaagtctctcctgccaatcagagatgggaatgaaagccttattggaacaatcaggccagtctttcagaatgtgtgctctctgcaagttaaagggagaaccaggaagatgcctcacagaaacattcaggccaagcttagctaaagcttgatctattc

SEQ ID NO: 138055 - DNA, 1419 bp, Homo sapiens
ttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttgaactgtcattgagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagct

SEQ ID NO: 138056 - DNA, 1093 bp, Homo sapiens
attaaaaacagtattttaaaatctacaaaaaaagagaaaatttttttataatttacttaaaccgcaaaaatctttaaaactcttactagtttttaaactaaagtggatatttaagaatattagaacttgtaaatataacttctgagcttgaaagatgctacatttgtgctcaagtcaggagcagtggaaataaaccctcgtatacacacatacacagcagcagcaacaacaaaaaccaaaattaaatgttaaaccctgaaaaacaacaaaaatattttaaaatgtgcattaatcaatttttaaaatatttggataacatggcaatttaaaaatgctaagaattttaaaacaaaacttccaggaaaaatgtatcctgcaagttgctgaacttgtgccagaaagtggttaaacaattataaagcacagaacaataacaaaaaagtaaaacttctaaaacaataagcaaatttttaaaactcattaacttgtttttctttctgatgatatgcagacttaaaaatactgagacttttaagtaaaaatctgttagcataatgtaactttaaaaactgtaaaatctgtgtctgggttaggaacaaagtgaaaaaatgctaaaacaatagtaaaaacaaattcttaaaactggcattactttttcccaatgaaagtcctaaaagtaattatgcattatgtagtcttatgaaaagaggctatagatggaatatataaggcattagattcagttaaataaaattaggttaagataagttcagttgttagattatatggtaagatcaaatcagtaataaaagcgtgaataatcttttgtttctttcagtattcatgtttttccatttcttgttaagtataaaatatatgtgaacatttgtttgtgcccttgcttcttaacattataaaattttatgattatgacaccaaaccatttaatgggatattaactaagttgaaataaaatatattattaaatgtttcttgtgtaatttccatgtttagttttaatttttttatatttcacttctcaaatttccatttttatagttaatataaattgctaataataaaacttgtcaca

SEQ ID NO: 138057 - DNA, 1049 bp, Homo sapiens
tgcttttattcctagttttttaatgatttttttcttttttaattaaaaagttttaaaataattttagatttaaagaaaagttgtaaaaatagtacagcaagtccttgtataccttctaccaagcttttgctaatgttaatgtcttacagaaccatagtataattatcaacataaggaaatcaacatcactacaagataaataaataaaccacagatcttatttggatttaccagtatttccattaacatcctctttctgttccaggatcctacgttgcatttagtcgccatatctccttagtctcctccagtctgtgactgcttattcagtctttccttgcttttcatgaatttgacacttgaaaagtacgctagtctgttatatcaaatgtctctcagttcaggattgtcccatgttttctcttgagtagattaaggttatgttttcggcaaccatgccatagaaacgatgctatacccctctcagtttatcatttcagaagataaattatactgaaatgttttatcactggtgatgttaaccttggttaagtggtatctgtccggtttctccacagtaatttctccccttataatcaatgatttctattaatttgatattttttaacagaaaacaagtgtagaataaagaaattgttccagttcctcaaaagcattgtgactagttggttaatattaatcttatctcatatgttttataattttaatatcttgtttgcaggtagttatgttggggaaataactttttgaatagccttatccttaatggctcttttcagagccattattttacttgaagtttgctgcaaaagaacttaataggaatgccaagaaatgtgataaagaagaaaaggctgaaaaggccaagattaaaaggtaagtcacttttaatatatttacttttttaactcatgaaatgagcataattaatcatggaacaatgattaattatacatagtttatttcatgtgaagaaagattaatatctttagcattctaagccaagaatccatttaaataaattcctt

SEQ ID NO: 138058 - DNA, 1175 bp, Homo sapiens
actgctaacgtgttccctcctcccttggcttttaaaaaaaagcttacaatatgtttaaatgaaatttgcataacaaattgtgtaatagatcatttgaaaagtactgttttgttacccttgagtattattcatctaaaatattaataatgaagtgctggtagttctgaattatttccgtacgtttaatttataaattagattcagtattgtttataaaacaagtgtttttgtctagtctgaccctatagagcaaaaaatatgcccatgatatcctcatagtcatgaaattaccaagtaatccttttacttttgtagatttgtgttcatttttattctaaatgtggttagtcgttttcataagaaaaagaagttactaaaacaaaacagtagttgaaggttgtggtacatacatttttgctttccgtttttttcaaaaatttaagactgctgaacacaacgacaagtttttaacactaaaaataccttttataagtttgcttgtaagtattcaagcagaaattctcagagaattatctgagataatgagccacattctttctctaaacatgtgttggtatctccttcaaaaaagatgtttaccagtgggcagttgtagcctgttctcttcatattagtgataagaaatgacttaaaaaaaaaaaaagactagactgttgctacctagatttgttcacttttttattcattcattcagcatttactgagtgtcttctatgtgccaagcactataattttataaagagctttacagttcacaaagtccataatctcagtcatcagaatgacatcagttaatttcatttttcagatcagaaagatgagttttagtgaaatcaagtaatttgcctaagcctacatggctggtaactagaaaagccttgattcatccggcatatctgcttccaggtttctcgtcttaacttttatatcttattaataagatgttttgttctttctttcttcccaatctctatgaaatggagacttctaaatcatgcctgtgtatcttgaaaataacatttctttttgcttctggctcagatctttaataaagaggaccttgagatatggatcttcaaacatcttagtgctttggaatttttaaaactaccaggtttggaagtagaaaaatgattgaagctcaaatgattgaa

SEQ ID NO: 138059 - DNA, 3386 bp, Homo sapiens
atttgtgtgattttggctatctggagctttatttataatttattttgaaaaataaaaatgccacatttatttcccaaatgtcaagattttctagaattagataattagaataataaggctgaagacattttaaagcatattttatatgtagtgaaatactgtgaaaatattagtgaacagcattttgctgtaatgtttatttcagttattaagatttaaagagttagtcatcagggtatgttagataaacatagttatcatttattaaacaaacagataattttctgtttgcatgcaaattattttaataagtgtgaaaataaaagtttggaagatagtatttttacttttatatctggacttttttttcccccaatttacactttgctttcttgtaataccacctcctgtgaatgtgttgtaattagtatcacattgattactttatcattttaatttctttgaggccctttaaacctacgtaaaatctgggtccagccatagcaaagcaagtacaaaatgaacaaagaattttgaagaaaagcctaaatcttaaattgctaagaaaaaacactgttatatttaggcccgtgagagcatatacatgtataaacctaatcctatgctagatatgaatagtcagtgagctgtaatatttctcataaatgctaataatgtttaaattcccagctttaagatcttagtgtgtgtatatatttataaaatctgaattgtgtgtttcttctatggcttactgtgtgtttctctttcagcaataggatgctctctaaaacattcactagcctactagcctacttactaaatttttgtatatgtgtgtttgtgcacttgtatgtgtgtaaagttttttccccaacttgacacaccttatctcagacattcaaaaaaagagaacattttgtatggaggacagtctgccaactttttgcctctctacagctcttagcctgtatatttactgcttgatcattcattatgccttctagataaccagtccaggttttgtcatatacctgtgtccctctattctttttatttccctttttaattttttttcttttttttccctccccagaaatcaggcttgtgttggaattcttctctataatactttgtttcccgcagatgcaaagtaacaaagtaactgagtaaaattagaaatctcattctgcacaactgtgcgctcagatatttaactcagccttctaatacttttaagtacgtttctgttatttatctttttgttgtttttgttttaatcccatagattgtcatcagacaataatagagtgattgagagagaaagatataaatgccacttctaactttttgataaaacttttttgagcatttttcaaaaatttgtatgtttgtggtaatggggaattaaacaccttttacagctgatgtatgttggaaatcattttatgtacatttaccaactggtacttatcttcaagttggaattttcacatccataaaagggagacttgcatcatatataattttcagtatactttgctgtccagccttttaaacaattacagtaacattttgagttctgtgatgaatagttctaggggaagggatggaactttcgacatgtaaagtccattgttttaaatgctaaccccatccccaatatttttgtggaacgtgaggctttatgaaaggtttatcagaaatagaatattctaaagtcacttttatggcttatttcaaaaactagtgtgaaagtattttcatgcttttttgtttctcatcttttagcaaagcttctttaccaagttttgattaaattgcaatataaaattaagttttttcacggtgctatattttgtggaatatgggtagcactcaggtttctttcttttttcttttctccttccttcttccttcattccttcattcctccctcccccctccctccctccctctcttccttccctccttccttccttcctcacctcggcctcccaaagtgctgggattacaggcatgagccaccgtgcccggcctatatacccttattcttgattatttcttttttcatcttttcaatcctgcttacttttatcctcacttttctttctgccatgaaaactgcacctaatttaccacacttaagattggcaatttttgattcattgatgggagaagtacagtagaaaggccctgcagtttagaattaagttgtgtttgtttatttacatgtatgcccatttcttctaaattaaatctagaatgtgagactttgacatataaaagcatgataagtattttcttaaaaaataagactattgatacataatgaaaccaccattggtaattgaattttaaaatgatatgcaaaaatatttagaaatccagttgggaaatgtgtttttgcatatgtcaccagatacacattaggcagtactacaaatgttaattcttaaacaatactgtggtgatggcaatcagtaatttatttctttgtcctgtaacttatcattcttgtcttttgtaatgtcttacacagtattaacataactgtaccttttttttgttcttggtatccatacattttaagatggaaaatcagttcatagttgatatgatattgtatatgggcaaaatgtccgttaaactaaaattcagtaaaaaaggtaatataaactggcttgatttataaaagatgttttgtttggcagttatcagtcattataagcaattatcttcaaagacaaaaaaactggactaatttgttgccattctttatgggatgtttacaataaaattccaagttgtttggaatcaattgcactcttgctgctttatgccttaatttatgtaccagagaaaaattaaccagaagaaagaaatatggagttacctattcagctttagagattgtaacatgtaactcttaggtctttcttgtttctttgtcatagaatattttattactattactttttaatctgagaaactaggatgcttcttcctatcaaagaaaaggttttgttttttgttttcatcttagacattgcaaatattctttgggtcacttttaggataataaatatgatgtttacactttaaatgtgggctgcttggtgcattcaataacagcctgcaaagcatttgtcaacattttgttttgcagagcttttcaaaatgaatagatctctaacatatttatgacttacaacttttaacagctgagttatatgtacctgacattttaaaatgtatagtaagattacctacattgtaaatggtgctttaattcagtgtaagtgtaggagagagagaagtgaggtgagatgatctgaatgctctaacaggaacattcataactatatagttacccagaatttgtc

SEQ ID NO: 138060 - DNA, 2816 bp, Homo sapiens
agataatgaataagaatttatcaaccgaatgaatgaaactatactaattagtgttctcaggtaattcttcctgaagtaggcccttaaaacttctgcctaaacctcatggccatcattccacccccatattctcctccctctcccaaaaaagcagacaaaaataaacactttaatatcttctattttgaagaaatttaagttcttagtctgacaccctccatgattgtattccacatatttttgggaactgtagactgtttttgaacctaaataaccattttgtcaatgtcaaagcttaactattaaaaatcattcattttaatttagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaacagttaataaatttagaataacttaaaaaattcaatggccttctactgcagggaatttaccaggaaatctacaaagcaagttgtgtggggacttctgcttcctttcacattggtgcttttccatttatgccagtatacatttgtttcaagacttttgatctccacacttcatttgttcaaataagccttactcattaggccttaaattaaaagaaattctgcccacacacacacaaacacatacacacacatacacacacacagacacacacacacgaaacacaacacagacactacagatttactacattaaaggagcattcagcttcttaagagtagcatgacatttttatctcaatagaatagccctcttttgcttttgtatcacagaagtatagcaccttcttacagagttttatatagtttgtttttgccattttgattcctatacccagtaataataacttttgcacaatacaccaatcctaaaggcagctattaaatgtttacagtttctatattgtaagagcgatctggattattttactcttcccaggccaaactttcatgacttgtactgaactgaagtatatatttatactacagttttttggggggtggggggatcttgatatgcttttcattgatttgcataattcacgttaaaggtgagaaagggttggtgccttgtaaatatgtagcagatcttcgtggtgtgttctgatgtgtgcattaactttattaaaaaagaatacttgaggtatcaatctagacaaggtgccaaatgcaaaagtttcccgcatcaatttttttcctatcacattttattgcattaatagaatttgtgtagcttaaataacttaaacatttgaaaaatcctcatccacaaagaacaacttctttgaacagtagctcagctacctcttaactacaactactggaaacattaaggaaaatagatgctgttattccttactgactaaggagaaatagaacaagcttagtaggaatgaataccccataagttataagctgagaggttgttaataattgtattggctctcaaattaataattgtaattaacaaagtttcataaatatagtatgctctaccaccttaggctttcttagaacatatttgtgtaagtagacttgggctactgcttatatatttctgctccacttaccatttaacagctgtgagttgctggttttcatttgaatcttaaaatttaacaaagcacctggtttgatttggaatgttttggctagctagtattatgaatcaacttatagattctgctcatatcattccaaagggttcttctgttctagtctttcaggaaagaaccttattgcactgcacactcatgttgtgaatcattattttatagataaaaaacatctttaaaaacccttattgtcttgtttacagcagtagagtgcacatggttccataagtgagcttgagttccaaggtcagttttactccccaaatttaatattacagatttgttcatttgttagatacttacatttctgaggtaagagggataatagcaatttctgtttctgtaacagcaaatttgttgcacttagatcaggctcatgggataaaacagacttcttagtatatacctagctatcccaggatatttcttaagctaatgtgtttgtctcatgctttcaatcatttcatgcatctgaaaacccttaagtgcagaggaaggcgta

SEQ ID NO: 138061 - DNA, 1042 bp, Homo sapiens
gttcagctatttgaagtttgtgaagaatagttaatatgcttttacaaataattttattagaatatagattttattttatatacattttaatgcaagattaagtagcttatccattgttatttaaccatcaaataacttaaaaataggcttttctgaagatattttatagtggctatgtaagaaatgttgaaacatatttgattacttgaaaataattagtgcctttgtttttcccagtttacatctttagtgtctcctctgatcttgcatacttatgccattgccttttttcattttacccttccttccactgccaagattaacccatgcttccttcatctattttgtttttcccatccacagagtcgtttatcctttatagtacggtgtctgtcccgaccacccttcaaaagctgttctcacattcatcagtactcttcagtggccaactagcgtctttttttagtttcaatctctatatcattgcatgttgttgactaccttctctatgaactctacttgtaagcttctatactctattgattagcttatatctcttatttctgtttcttctctttgactctactgctctgtatttgcagtttgccactgttttttgcttgtttttgtcttccacaaataaaggattctaatgactgcatccgtcatcttgatgtgatgactctccaaatgcatatgcagagcttaaatatctctttattctattagaataatttccaagtgcttccttaaaaaataaaaaaataaaaatattcggttgcttatcttcgcatctcaaacttgcttctttttctgtgctcactattttagttaatggcataaccatctttcttgccacccagcttaaaatctcacagtgttttttgactcttcatttatccctcatacctagtcagttgccaagttttgtggattccacaactctttaataccacttaaatcttctatatagtttctactgctatcaccttagtctccagcctgaagtattagtcagcttgggtttccataacaagatacc

SEQ ID NO: 138062 - DNA, 1076 bp, Homo sapiens
tgaccaatttgaccctgacccttaactaatgacacttaagtagaatgttctcatagcaaggaatcgtggaaatatgtgcctaatttgtagagtggaacaatttaatcatatgtgaataatcccatcttttatcattaaacagtgtgctggggttttggaggttgtatcagcctttaagcaagacatggaagctgtagagatgaagccaacggctatggattttctattctttaccttcatagttatttacggttattactgtggtgtgagggctaaggctttcccacagacttatgctgtttttatgagccaccaaaagatgttttggggttgtggggaggtagttggcacattgaaaagcaatgtgtttatttcatggtggatcgtagtaggtgataccaattttagtcccattgtattccttaatattgctatacagtatttaataacacattcttctttgtaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaagggtatgattattagttgggttaattatcaggcagttttctttaaccagttactgaaaattggtcctcagtatcttttttgaaacatggattgcttgttaggcatgcataaagatacatttagcagtcattctgaaattaaccaccttttcctttctcttatttgtctctttactctttagtaataaatatttataggtaccagagaaaaaacaaggagaggagaggtagtaatttaagtacactttaatataataagtgacttaataaatagaaaggtgattgacagtgttgatttatgtgaaatatttttattagctctgaacatgtatgttccatttattctaacaaataatgaaccatcttgggaagttgtaactgcttatttatactcacatttaatatcttccctatttttgtcagaacttaaagtatattgagaatagaaaaatagtaatca

SEQ ID NO: 138063 - DNA, 1024 bp, Homo sapiens
cactagtggtgcttgggtcttgactcttcatattaaaaaattatcccttagagagatacttaactgaaatagatctcttttctataggaaaatataaatgcatattatatgagacctatttcttgaaatgtcaatggagtaatcatgaataattaataattttatattaaataagcatgtcatatagaataaggtttttaaaaaatactaacacttagatacaattttagcaaataccaaccactacactgttcccctcctttccgattcttgtttaaagagaaaccttgtttaattcttcttccagtatattttccagcttgtacactgcatattgggaaagtttggtgtgagtctccctctatcttttgttctacttgctgctccagtggggaaagttaactgtgattttatttcccgtttatttgtaaatgtccatctaatttatatgactttgaatgtaacttaacgtcttttcccactcttcctttttaattaaggatacagaaattgttgatttagattcagacggtcctggtacttcatctggaagaaaggtgagtaaataagtgaactgctgaggagatatgttttcaggtttcctgtgtcagtgatccctaagaccaaccccatatttggagaattgctagaaggattcttgcaactaagtatattaggtatgctcattgataatatttattagagtgatgcagtaagggtacccagttgagtcatgggtgaaaagacacaggcagagtctggagaaaattatgtacaggcttccttatgctattattatctttcccctgtgaggggtcacatattacactctttttccagcatgtgtgtgattagagactcagtccccaaagattttactaggggctggttatgtaggtaccctctgactagcacgtactaagattccagattcccagaaggaaatcaggtattcagcacaaatcacattgtttatactgtctaggtgcagtaaactgtcttaataatttaggaagccattcaa

SEQ ID NO: 138064 - DNA, 1289 bp, Homo sapiens
agtattccatgactggttaatctgcctttgcaattgagaactggttgtatttttataatatattattttgatttaatatttatatcataaaagtaattagataaaaatctgtcattttttataatctgtttttttttcttgctcttcttggctcttcccctgaaaactaaactaaacattcttttgaccttgtcaaatgactctttacctataatgtcctaggtcagttctatttgaagttttgtatatacattccagtggttcagaatccctgcttgtgctttaaatactgtaactatatcatctctttttagtgctcatcagtcaaatatattgagttatatgcatattggaacacctttgacacactgtgtttaagtacatatttgttccatattgtatattcctaaaatatactttaaatatattagccaaggctaacagagtattttttctttcacaggagaatatcagcattaatgtgggaggtacgctatattgaacataatgccaggactttcaatgagccagacagtcctatagttaaagcagctaaaattgtaactgatgtcttacttcgatttattgggtaagaagcagttttagcttccagagagtctaacttaaggtttttaaaaaattaattttaaaaaaattaattgaaaaattgtaaaaattactgaagcttttgaaatgacttgtttcttagggatcagagctgtactgatatactggatacttataataaaattaaagcagaagaacgaaacagtactgatgcagaggaggtaagaatcacagcatgattagtaggaatgagttacttttctcttatttgaagtacagtattatgtgtaaatgttgtaattggccatgaacagcaaaacagatttttgaaatctggctgaataccagcgtcttttaaagtgtacttagatggcatataccaaaaataaaatagagctacagggtttattcagagacaggtggccagtcatcatatttgacacagtggatgtaagtgacgagaaatcaacactttattttccaacatttagaaacaagacaagtgctcaatattttaaaagaatgcttagttgatggaaatttcagtaaggattttattttctatatgctgtatagaaaatattaaagtattttaaagtttcaggcttgaaagtctaaatttttggtagtttcatgaaattattactcgatttcctttctgaaaatttataaagataaatcagtctcttctgaatgaaatggaagtagtactcagcagaccc

SEQ ID NO: 138065 - DNA, 1108 bp, Homo sapiens
aagaatgatagacgaaatgtttattctctgaggactgacttttagtctccatattgacaaaaagtaggctttctgccctctaagtttcatagcgatggaccatgttttctctattagaagtttattgttatctgtatgtaaccggagttgtactttcaagacaactgtattgccctttttcaaatttcacccccaagaagtcatgtaaaattgtggtagtatatgaaaggaagtactatatgattaatttgatttgcatcttcttattttttaatagctgggacaataatgagagagaaaagatgagcccatgggatatggagccaattccagaaggaagtaaatatgcttttaaaaaatgaattataattcttttaaaagtaaaatggtaatcacatgatattggaaaataattttttctaatttttttttttttatcttatacctagctgcctttccagatgaagttggtgctggtgttcctgtctcccaggaagaattgactgctttgctatacaaaccccaggaaggagagtggggggctcattccagagacgaagaatgtgaacgggttattcagggcatcaaccaccttctttccctgggtatgatgaatgtgaaaaaattttaggagcatgcaagagagctaggaaaatcagcagaagttttaagttctacagaaggatatgcagtttctcactgtacacttcagttttaactcaagaagcacagtgattctagttttaatattagcagttttatatgcttggccaaagtaataactgataattttttgtttagcaatctgggggataatagtgaaggtaactgtgtaagtgtctttttcctttttgaatcactttgattctctagctattcctgagcctgactttggatgggtttcttggtaaggacagtggatgagtaatgtattttacccacatgagtagttaaatttgctaaaacatgtcacttgagaagtttggcatttatctaggaaagacagaaatctgaagttaaacccagtgctcctctaattttgttttacctgatttgaaccagtgtatcatgcatgattcatagatatgatgtccaaatataaagaata

SEQ ID NO: 138066 - DNA, 1052 bp, Homo sapiens
ttctgaataagagactaaagggccattttatgatagttttccaggtaaatgaagagttgtgtgatgattcttgacaggaaggatataagagagaatatgtatatttatttatttattttttatttattttgcaacggagtctcgctctgttgcccaggctggagtgcagtggccctatctcggctcactgcaacctctgcctcctgggttcaagtgattcttctgcctcagcctcctgagtagctgggatcgcaggtacacgccaccatgcctagctaatttttcgtatttttattggagacaggattttgccacattgaccaggctagtctcgaagtcctgacctcagggtgatccacccacctcggcctcccaaagtgctgggatacaggcatgagccaccgtgcccagctgagaatatgtatatttattaagataaagatttgatttagatgtttgtaaaactttttattaatgtcatcaggtgctaaagtagcttatcaagtgagctttacataattatcttctggaagatagggacagctcccatctattcgtcatcaagtaaaagttgaatcttttttagaatcagaggattcaataaaacatgtgatttcttactctttttttttttttaagacagagtctcgctctgtcacccaggctggagtgcagtagagcgatctcggctcactgcaacctccgcctcccaggttcaagaaattctcctgcctcagcctctcgagtaactgggattacatgcacccaccaccacgcctggctaatttttgcctttttagtagagatggggtttcaccatgttggccaggctggtctcgaactcctgacctcaggtgatccacccgacttggcctccaaaagtgctgggattacaggaatgagctacctcacccggccaagttcttactttttatcctaaccttgttgtcctaggaaattgtaggagcagcttatatgtggtaaaagagcttgggctttggaataagacctggatttcaattctagctttgctatatgctaatatataactt

SEQ ID NO: 138067 - DNA, 1264 bp, Homo sapiens
agttttgctcttattgcccaggctggagtgcaatgttgcgatctcggctcactgcaacctccgcttcccgggttcaagtgattctcctgcgtcagcctccctagtagctgggattacaggcatgtgtcaccatgcccagctaatttttgtatttttattagagatggggttttgccacattggtcaggctggtctcaaactcctgacctcaggtgatccacctgcctcaacctcccaaagtgctgggattaaaggcgtgagccaccatgcccggcctaattgtattgttatatatatcaaatattttcaatctgcagttgattggatttgttgatgcagaagctgtggatatggaggggcacatatactttaaaatatgaccagttttgtgtacattttccatgaatctgcttcttcagcacacttatgaagctgattgaagggaaaggactgtgtttactgtgtttatatgatgtggtactgagcacagggctacgtaggcatgaatactgaattaacatcatttgaaacctttattgtataaagtctttcaatattataattatttctttctgcaaacagaagaggatgtttgtaggaatgtatattggacatacagagttatataggatgctgctgtttaataccttatgttttctgttttagcttatctattttaggcaaggacatgaagcttatgttcgggctgtaaggaaatcgaaaatatacagtgttaatttacaaaaacagccatggaacaaaatggatctcagggtaagtttgccaaattcataagctatgcaatggaagtagctttggaattaaattgcttacccatggttttttcccctcagttttatgcatatttcactgttgattgtgtatccaagataagatgatgatctatactcttgtagaactgaatattatggatcacattttatacgtttctcaaaatttgtatgctattttctattgtctagtctatactagtccataattagagcaaagcaggagttcccctttgtggatattttccgtaatcagcaactttttaccttctggagcctccataagctgagtgtgtagactataaacactctcaaggttctgacagctttggtatattttaaatatgataaatcacaagaagcccagaaacttttggtgttttgtaaaatagctgttttgatatattacccttgtagctacatatataatacccatgtggctccatattttatggagaatgattttgtcaata

SEQ ID NO: 138068 - DNA, 2435 bp, Homo sapiens
tcaatatccctgtcttctacctccacatcttgcttgtcccactggaaggtcttccggggcaatatggagctgttatctcttaggttaacaatgcctttttctggaatacctccaggaggaccttcttgaggctgttttacagtgcaattttttttaataattaaaaggagtacatttcaaaatgatacgaagtatggtatagtgcatacataaaacagtaatatagtcatttattaccaaatattatgtactgtgcataattatatgtgctatgcttttatataactagcagtgcagtaggtttgtttatgccaataacaccacaaacgtgagtactgcattgcactgtgaaggctatgatgtcactaaacaataagagtttttcagcttcattatgatcttatgagactaccgtcgtatatgtggtttatctttgactgaaatgtcgttatgcagcacttgattgtatttttaaagatgagaaggctctcataataatgtctaatttgggagcattggttaagtcagacacataagctagtacatcaaaaatatttacaaatgtttcatttgatatatactttattttacgtttaatgctgtttttaatcatttgtgtagaaatttataggttgtttttactatgtttaaggtatactaaaatgtaagtaattttgtggctttgtatctggtcttattaaggtgatggtgaggtagtagaacaggtaattgggcagcaaaccaatgaccaagatgagagcattcttgatggaataatcagggagctgcagagagaacaagacctgagactaattaatgaaggagatgttccacatttaccagttaatagagcatactctgttaatggtggtaagtatttttatacttgtaaagggtgtagtttatgtactgtaattattttacttttaccaaataattacatggaaaatattttacgtttataaataaaaacttttttattaatttacaattttgatatcagatatattgaagtctcataatctcatcatttgtggataaaatgacttaaggtctcctgagaaatacaggtgatgcattttaatacactgtcttctttttactcagtaatttatctgtaatctttacatttgttttaagaagtgaagtgctacggtaagtctagcccttttgtagaggaaacaacctatatagttttcaaaattaaaactaccttaagtttagaaattactaccaattcctcttttgtggagaggaaagcagaataccatgctcttctcttgaataaaaaaaaaaaatacactgaagacaagaagcactcttagggaatacagatacagcttctgaattaacttttataatagtttgatcttaataccagtagaagttattgtataattaattatcttaaaatgaatattctatccttaaatgatattaaaatgatattctatcctatcttttacattaaacgtgccagggcatctgagttttatataagttttagcttgtatcaagagctatcagttttattttcaaatgtagtcatcttatgagatttttcagatttatttcttttcatatatttgtaactagagtcatttatctgtgtaacattgcattttagattccatggaaatgaataaggtgatttaaatttgtggtgattcacagggtattttactcatttcctgatgtcttcaatatctcataaaattaaaatagttcatttaggttacttgaacacctaactcagataagcttttctgaacctagaacaagatgacaagtgggctgataatcctatctatccaggccctttattcctgagacataaaactttctcagaaccctgatttaaatatccattaatgaaatctgtattctgttgtaccgtcaatactaggtttctgtggacagattagaaatggcattagtcaagagaccccactgacttctatttgtaatattgatttgttttgaaatttttctgacatttaacagttggatgtttcagtttccatttgtgttttatttgtaaatataagaaaaataacatgaacctttctggagtattaaaaagtaaaacttctgttactttgttttctttctttcgttgctcatcaatcttgaaaatgaaattttgatttaaaaaaatatttatttacactttgaatcttaacatttttgaaagttttattgatgttttatctagaaacactgtaatggagagaacaaagatagaatttagatcaaaaagctccttcctgaactagtactaataaacatttgtaaatctccaaatcatgttgaatacatttttttatattcattgagcatttagtagatgtcagatgtgaaactactttgaaaaaaattaaaataattatagaaattttaaacatttctcaataagagtgcctgctttatttata

SEQ ID NO: 138069 - DNA, 1833 bp, Homo sapiens
tatctttccattagttgcaatatagaaatgactttttcatcatagtcgcccattgataatgtcatatttaattacataaaaatggtactaaatctgcttttttataagacctatgggtttttaaaaacattcatatttaagataataaattggccattatgttttcatattttctgacaaccaatataagtatgaattttatttttcaaggtatttatagatttcttagtagtttttggttctcaaggaactatttaccaaatttttgtcattttagggtctttttttctccctgaaataagctaatgggtattgccctatgcagatatatttatttttttctttcatgaatacttaacggtatagtttaggatttttaaatctaaacagttgtatactcctggagaaattttgtcataatttgctatttaacatgcacctttgtcaaaaatttataagatatgaatactgcaaattgttttgtttagcaataatttgccatctggagaagacaagatcactaaacttaaggtgactatggtggcctgggatcgctatgataccacagttattactgcagtgaacaattttcttttgaaagtgtggaattctatcacaggacagcttcttcatacattatctgtaagtattttatttttagagtaattaaaatggtcaaaaagcacattattttaagacacaggaaatttaagttccaggttcctttctatgatatactatactagtccttggaaaaatgattttctgagagggctctgttgacatatctgtaaaatagggatgacacgcgctatacctgctaaaagcaagtatgaaatcttttcaagatcttttctaagtctggtagttactcatctactatgttattgtatacaatgaggacatataagttattttgtttttagcaggggttggcattttttcattgttaccgttataggggtagagcgtaccttatttcaacaagggtatcctacatagttttttcaaggaataggggtaagaggaagaagtaggaaaagaaaggtcttttttcctctttcagaaagtgtatttgtcattgtaagaggctgtagtatttgttatgtaaaaagttgaaaggattaatagcagaaatcacatgggtagtgttgatgtttttcagtttatcataatactggttgacttcagattaagcttaatttaaaaaccttattttttgtctgtttcaactatcaattcataagcattttaaggagagaatgccaaatggttgccatgtgattacacgatagtaagtgataagaatagaaaccaattcttctgactcaactcagttgtctttatactatatcatggtgtttatgtatcagagggatgtaaagttcttctattttgcaaatgctgtttgagtatcagctatgtgccagaagtggcttaggtgttagatataaatggtaaattagacagagtcctgtcatgctagagtttatagcctattatgagaaatacctttaatcagataagtgctaagaaagaaaaatgcaagatagaatgcaaacttctaacagggtaaccaaatttgatatgggaggctcagagaaaacttcctgaggaagtgtagtttgggttaagttttgaaagataagtaggaattacccaatctcaacttgtcaactccttgattaggccttccctgatcaaacaatccaaggtagcctcctagtctttgtcttattatgtcaccttgctttacttttattaggtttatcactatctgatattttattgttatgttttcttgtttattccctgcctctacatggtaggaaa

SEQ ID NO: 138070 - DNA, 1063 bp, Homo sapiens
ggtaaccattaatctactttttgtctttataggtttgcctattcaagattcatctgtgttaactgtgtctttctttctttctttctttctttctttctttctttctttctttctttctttctttcttttgctaaataatatttcattgtatgaatatgctacattttgtttatccatttatcccgttgatggacatttgggttgtttccactttttgacttattatgaataatgctgccatgaatattcatgtacacatttttatgtggacttatgttttcattactcttggatatatacccaggagtagaatttctgggtcatatgataactctatgtttaacattttgaagaactgccaagctgttttccaaagtgactgtaccattttacattcccctcagtagtatgtgagggctaatgtgttacttatattatcaaaaaaaagtgatttacatttttgagaaaattaataaagttattttaactctttctagtttaagatttgttagtggaagtcgagatggaacggcaagaatttggcagtatcagcaacaagaatggaagagtatagtgctagacatggctactaaaatgactgggtaagaatatatgttagatgtttatgtggttctcatgatatattttacattgagtttaatagtgaatataaaatatctttttacattaataaatagtttgaagttaattgtagacatgaagtttgcatctgtacagcctctaagcaaatcttcgttactgttgattgacagagtggatgacaggaacattgctgattcatttgatattctggtcttttgtgactcaaagatctctgtgttctactgatgcctacagagccattctctgccttagttttttataggtcattaaaaaatatatctattttactttctaccttgagagttgtccctattaaatgtcatcatatgtttaactttttctctaattttctaaggacacttttataatatttttcctactcagtaataaatatccacttaatcagcatttagttttgtcatcttcactgttgattgga

SEQ ID NO: 138071 - DNA, 1039 bp, Homo sapiens
atactgttgtttttttcatagtttcatttgcttgtttattttctcatttcttttacatattgtagtgccttagagatctgtagacctctctatcatactctttctcttagtcatctcatggttttgaatttaatctgtaaactgatgattctcaaacttccatctccatttaggatcttttagctccatacttgtttatgcaactatcttcttggcatcatcacatggatgtctactaggtatttcaaactcattatattcattattgaactattttttcttccttagatcttctccccaagccttttcatccaaacaaatggcaataccatgctttcaactgctcagagtagatcatcccttttatctttctcttatactttgtgtctaacttgtcagcaaatcatgttggttctaccatcaaagtgtatctagaatctggcaaattctcatgacctctgttattgctgtcctgttttaaggcactatcacctgtggtctagattattgaaatagacttctaaccgatctgcctgcatcttccattccctttcccctgcacccagtttagtctctcagtttaacagacaaagttattttaaaatggcagttaaattgtgtcactggtgctcaggaccatcagtagcttccaatctcagagttaaagctgaagtcttcacagtgactcacagtgctctgtattctcagcctccttggcgctcttcaatctcatctactgcgtgtttgtttgcctttttcactctgcttactgctggccactttgcttttcttgaacattctaggtacatggctgcctttgctcttaactgtttcctgtctctggagtggtcttccctggatattcacatagtttgttttctcagtttctatgtgctttgtgcacatgtcaccctctcagggagaccttctctgactaccttattgctctgattaaaattgtaaaccactgccccccccaccccctccactgtgtgcacagcaactctgtatcttcccttctgtttcatttttttgtctg

SEQ ID NO: 138072 - DNA, 1664 bp, Homo sapiens
attttatttttatatttgtatgctacaacgaatgaagtggaagttattcgggaagttattacaccttagagtttattttggactcttccattaatgacttaatggctctaaatgcgtcacataagtatttggatgttagtgatcatgatgaggatgatgaatgctatgttttaataaatagataattgttaagtaacttttctaccatagtagagtagaattgctttttactgttcactcttctgaaattctcaaaaggaagtttaatatatttttaccagaaattatcattaacgggtagcctcatgtttactgagaaatgcatgtagactttaggttaaattctgaataatttgtggaaaaaatatttaaataatttagaaaaaaggctgtcaagcctaaagaaagaaatgatggtaaaaatacttaatgccaaatcactaaaaagtgagtttaaaatattttgcattgtcagtattggtggtaattttgaaaagttcttcacaaatgccattgtcactttggacaatgctttgttattgctatcatttggacatcatttatacttgctactggatccctattatatgtagagaggagactagaaagtaaaggcttagaagtaatttaataaaatcttctttttggctattttttgggtgggggtattgtgaatttctgcttcattataaacctattgtccttttgttactatagggttcagatgactgtttagtaaaaatttgggctacagatgatggacgccttcttgctacacttcgtggacactctgctgaaatttctgacatggctgttaactatgaaaacactcttattgctgcaggcagctgtgataaggtagtaagagtatggtgtcttcgaacttgtgcacccgttgcagtccttcagggccattcagcttctattacttccatacaggtaagaaaagtgataaaatttagcttgaacatatgtaaaaaaggtgagaattctctgatttcatgttacattgtatagataatagcccaaagaataacaagagaaaaatgctctcttctggactttgctcctaccctgcagcaagatatttttttaagttcctttttcatatgattatcttttttaataaataactaaaaagatgatttaaaaagttctataaatagagtgagatatcttatttgtatttgttaagaagggagaaaacctgtaaatgccttaagagcacactctttcctattaggatataaatgagttctaccatcagagaataccttaaacacctctatgcaaataaactagaaaatctagaagaaatggataaattcctcgacacatacaccctcccaagacaaaaccaggaagaacttgaatctctgaatagaccaataacaggctcggaaattgaggcaataattaatagcttaccaaccaaaaaaagtccaggaccagatggattcacagccgaattctaccagaggtgcaaggaggagctggtaccattccttctgaaactattccaatcaatagaaaaagagggaatcctccctaactcattttatgaggccagcatcatcctgatatcaaagcctgtcagagacataacaaaaaaagagaattttagaccaatatccttgatgaacatcgatgcaaaaatcctcaat

SEQ ID NO: 138073 - DNA, 1083 bp, Homo sapiens
ttgtattactcttgaatttttaggggcagtcatacatatggtggataggtgtgaggaggtaggacaataatttatgaaattcctgtataattttttagaggaatatacttaaccaagtacagttttattctaaaatttcttcatgttatagaaagatttacctatatatttaaaatgacagtctctttgactatagcgtaccaagaaaggcaaaaggagaatgtgcttgagaaaccacagtaagccaagcagaatatcagtcccttgggatttaatggaagagtattcttggtgctttcttgtagtaaactggagttcataaaatcatgaactatgtaagggaatttagacttctcacagggcagaattgctataatatatgtactctgttttgtctcatcttaatatttatgacttaatttcatgaaatcagtttcacttttaagttttaagttaatttcgtatttttttcagtgaatatcacctctgccaggcaattaaccggctgtagtcgctttggtcatattttcccttcatctgcttaccagcacattaagatgcataagagaattctggggcacttgtcatctgtctactgtgtagcatttgaccgaagcgggagaagaatttttacagtgagtgtaaaatttataatatggtaacatatatagaattacaacaattgaagccagactgcatggcattgcattgtgctttgtaagcagttcactttttttggatatatgggtgcagaaaaagatgagtggaaattgaaaaaagtttctcattttatataagtaaacgaatgaacaaaaatgtttactatcttcttggaagtttaattttaaaaagttaaatcttcagaagaccttatattctagaagtggttaatttatgtgaaacaagtgtactcaatttcatttcattcagttttaacaaacatttattaaatgtttgttaatgtgtcactcagtgtaattgctgccagttttccctaaataatgatttcatcactttttttgattagatagttgaactacactgtgatgaagattatagctattttttatatcttttttttgg

SEQ ID NO: 138074 - DNA, 1048 bp, Homo sapiens
gttgagaagccctgccttaaagtaacctttctcccctgcatctacctgcaaagtatgaagagacaaaagccaagcagaagtaatggttgattgttttaaggaactcagagcagtaagaaatgtttcactggagaaggaagatttctgaagtcccaaattagggtaccagtccttcctatcttggagtcatgggattttcttgtggttgagatgggaacacctgccaaaaagaaatcctcttgcctgatactgatgcttatgcagttcctcccattatttactcagcatcttgcagtattacataactactcaggtctcttatgtgttctaattgtttatattcaacatgtcactgattttgctattcattattcattttttgtcattttgtcagttaaaatggccagtggatctgcctttgcctgaaagaaagacttcattgctcttaaaattgtgagatgttgaaagatttcatatttttgattgtggcatggttctaatcatactaatctagctagaactcagttcttgctttaatcttgccctgcttgaacatgaagctattttcattttgtactatattatttatgcagtatggtaaaatgtcactttgcctcaaggtgacctttgaagttatagggagcctatgttttgattaaaatacattgtgtggggtgttaagcacttttagtgtataagggaagatgaaggatttcacagggcaagtgggtggctgtaaatttttacatagagatcaagatttgttttttagcatgagcagaatccacgtggtatttggagaagaattgtgtagacttatgctatgttatggctttttttttaagaaaatgcagaacaaggcaaagcgaacaagaaaaaaaaatgagataggacttaaaatgacttcataggagatgaagcctttaaagttcattgttaactacagggagagcctctaaattcagaaaccaaaaggaaagaacccatagacaaacctaggttgtttgtaacataaaatatttgtaacatcatagatttccttatcttt

SEQ ID NO: 138075 - DNA, 1032 bp, Homo sapiens
gctgcaacgaacatgagagtgcagacatctctttgacattgatttcaatccctttggatatatatccagaagtaggattactggatcatatggtatttccattttcaatttcttgaggaacctccatactattttccaaaatgtttcaatttacattgctgccaacagtatgcaagacttttccttttctctatgtccttaccaacacagattagtatttgtcttttttataatacccattctaacaggtgtgaagtgatatatcattgttcctttaatttgcatgtccctgatgactggagatgttgagcattttttcgtatatccattggccatttgtatgtcgtcttttgagaaatgtttgttcagaccttttgcccatttttaattacattttttttttgctattgagtttcttatatattttagatattaaccccttatcagatagatggtatgcaggtattttctcccaatctgtgagttgtatcatctgtctgctaatcatttcctttgctgtacagaagctttttagtttgatactatcccatttgtctatttgtgattttgttgcctgtgtttggagtcctacccaagaaatcattggctagaacaatgttctgaagcttttcccttatgttttcttctaggaaccttactgtttgatatcttctgtttaaatctttgattcattttgagttggtttttgtacatgttaggagaatagggttcaatttcattcttttgcatgtagatatccagtttcccagcaccacttattgaagaaactgtcctttccccattgtgtgttcttggaatctatgttgaatattgttttattttaaatgcttgggtgaatttctggactttatatcctgttcccttggttgatgtgtctgtttctacgtcagtatcatgctgtttctattaaataagctttatcatacattttaaaatcagggagcatgatgcctctagcttcattgtttttgcataagagtgttttagctgtttggggtcttttctggtttc

SEQ ID NO: 138076 - DNA, 1013 bp, Homo sapiens
ctaagaattagcctgtagtctgagaaaatcagatgtatttatgtatagtgagcgagtaaactcccaagtaacaatgaaaggcctctggataagagggatgagggaagtactttttgtaaagtttgttttacattaaagtattctgaggagggtctgatggaagccaggatcagttctagattggtggctgttaactgaggcaaattggaacaagtgggaattaactacggatcgggtaccatcatgaagcaaggacagtttaggaactgggtatctccctctggtaataagtgaaaatagcaaagcgggtccggggacattgttggtaagaaagcagtaatcactcgagagggagtcttcatgatattttacaactgccacatgaccttaggaaaaacaatgtttcctgttaattttgcagctggttttatctatgtctgtcctcccaagcctgattaattgcatggttgcttttttcttttttcagtcctagctgatattcactctttcagtcctggatagattttgactctttaacatgtagtcttataaatgtttcaaaagcagtggtcaatatataacattttgttattaattttacttaaggactttcctgaatgttcttagtctgttgagttgaaaatcctttattttagcctagaaacatttttctgacatcggtttgaagtttcatgcctgtgtgaaatagttgtaatacaaacatattttttttctaatgtaaataatgactggactagttagtggtctaacaactctgatgtgaccatcttggaatactctttggatcttgatgagcttttcagtagaaccaaatttagttgaagccagagcctttgctaatggtgttgtctctcaggtggaggtaagatcgagggatattatgtataatttttgctgttaaattatttcttattgcaggctcacagcagattacattttgtaaaatgtcattaaatagacaacattgaaaagtgggaagactattaaactag

SEQ ID NO: 138077 - DNA, 1027 bp, Homo sapiens
tcagatagaaaaatatgaatacttttttaaaaggaatacttcttatacattaagcttatgtagtttagcctcagaggttaagtaaattgaagctagaaatatttcttaagatatatttagacaaaatcattgattagacatacataggacttattcagggaaattggatactctgaagtatattgctaaaaatacttttccatagcttggatgttacttggaaaagttgagtctcattgaacatggtattgctaacttttttttttccaagagttgtttgtttatccaccagaattttccagtgttcactttgccttaaagctttagtcataattaatatattgaattgagataacttttgttattcatgcatttacttattttcaaaatacagtatttttagctatactgtcaacattattttgtagtgtgttatgcttcatgggtcacatgtgaaatgctgaagagcaaccattacaatattaggtttacaggctttctttatcccttcttcccttctctcgctttttttttcttttaactaagcatatactttcaaacttctgctggttttgtaaaataaactctttacactgatttgaatccgtttgttattcttttagtaattgcttaggaattgtcatggccctggcactgatgtttttaaattcattttaaatctggcatgttatttggggaggagcttttagaacagaggcaattcgatcatgatgtattttcatgtagtaactggtactcaagatgcttaagtttaagttatttagaattcaaagcctgacaaaaactcactaagatggatatgaaatctttccagtttgtgatttgaggcagttttctctttgtgggtcatagttctctatagctactttcaaaccaatcagttttataggttgccaatctaaacaaaatttaatcatgaaggtatatctttttttttttttttttttttttttgagacagagtctcactgttgtctcttgtcactcaggctagagtgcatcggcac

SEQ ID NO: 138078 - DNA, 1050 bp, Homo sapiens
tctgatatgcagtgctgttatctgttatgacacaactggcaagtatttcataatacgaacatgtacccaagtataaatatgcctgaattttccctggcatacttgtgctatagttatatccttgcttatacggttttatatgaatagacgtgtaagcctaaagatcaagaagaactgatgtaaactttaaagcttattaatctgtgacatatttatttaagattcaaatatgtgcataaaaaaagctttagttcaagactagcttagaaataaaatatccagatgatatgttaaggtgttgggtggttaccagttataaatttagtttataacatgttcaaatatatgcctattattttcattttggtttaataattaaaaatgtattccaacaaattaaattaaaatcagacatttgcttctgagacatggttaaaaaaaaaactgctctattccttagcaacctttgttctttttatatagactgtaagagtacactatggaatgggtctgcttttgcggctctgcatagaggcagacctccagaactacctgtaaattatgtgaaacctccaaatgtgggtgagtaatatacctgtgtgttataaacagattgttgattctttccttcctgaactcattaggaagacaaaaataggtaccaaaattaaattggaagcataaacaaactgtttacattcctgaggagtttcatggctagtccagatttttaaaacatttttacttaaagcaaatacaatgttttataaaaggtgatctttgttttctttatttcatttcatttcacttctttcttagcagaaacttcttttttaatatagtatagacgtttttagccatatggttgtctatttacatgtctatgtgctgagtttcccaaacaaaagtacattatttatatgtgttgttttccaaaattataatgatgttatacatttttatatgtctgtattaagacaaaaagtcacctttcttggttccagtttaatgaaattcacgtctcattcaaattattcttgggacatctct

SEQ ID NO: 138079 - DNA, 2137 bp, Homo sapiens
ggattgccttcacaggaagggaaagtcactccggagctcgcagacgcgaatgccaccacagagttccaaggcggctgccagagcgtcggccgtcagttagcacctccccctccttcccagagctgtagctaagcaaccatcgggctccgggagagtctaggctcagctgctgtattagtgcctctagcggggaactatgagcgctgcaaaaccctatcaccatttttaccctcccctctctccaccccctttgcccccgcccacctcttcgccacttcggctcctccctcttctcgctccgtctatctctctctctctctctctctccgcccccccaccccccgcgtctctctctctctctctctctctctctctctctctctctctctctttttcctctctctctctctctcttctctctctctctctcactcactcactctctctctccctctccctctcctctccttcctcctccgcctcctcagctcttgggctagaatatctatgggtcgaaacgtgatgcgatgaattcgagagagagcgaaactaggacgaggagtgcggcggaagcggcgggactcccgggcatgggggcttcaccacaatagaggcagcgcccccacccgcccccgccagcccctccggagcgaagcccccaaaccccctcgggaaaaggatggcggcagcacctacccagatcgaagccggtgggtagctgtgtcggggggtgggggggtgctaagggaatgggggcttagcgcgaaggctgtcagtttcttttgaaaaagcttctatttctcttctctacctccctctgaacctcttttcccccctcttccccagagctgtattacctgatcgctaggttcttgcagtctggaccctgcaacaaatccgctcaggtaaggggaagaaagagatctgggagtcgtggtgaatggtcccagtggggaaatcgaggcagcgggacgagcagttccgttgagggtgagggaaaggccggccttgactagtcaaacggtcagcggctgggctttaagtgtggagggaggaatgggttgatggcccgagctgctcctcatatctgtgtttcccttttgctcaggtgctagtgcaggagctcgaggagcatcaggtacggagccccttcgggaagggtggggagggttgaggtgagactggaggaaggggagggcaagtcaggggcggaagacgggctgggatagaggcttcgatctgggtacccgtagctgttgtcaccggggtgaattggcttcttccctcaaaaggggcagacaacgctggggtcttaactcgtccccgctttatgcttgtgggaggcagtttttcaggatttccttctcgaccccccttcccccccccccccatatacttgtctagctctgagccaatagctatcaggccgagagaaataaagacggtaaagtgttgaggactgggacacaggttgggtccagttgatggggagcggaggcttttccttcatcatttgcctccgcttccccctttcttttcgtccggcccccagctgattccgcgccgcttagattgggaggggaaagagcaccgaagaagcttcgaggatctggtgagtaaagttttcatttcaacttaacctaactctttcaccactccctccccaccttgtacccccaacccgccccccacctctcagccgacgaggttctagagctcggtgcagagccaaagaacgactgccccttcccccatccctgctagtcggaaaaagggtaccttgccctccccttggccctgcttgtttccacccgaaaactttgaagaatgtgagttgattatcagaggtgccgtgttgtggattatgaatatgttacaaacattggggaaggcccattgtaggcggaaaagggagagaaaccaaggggttatcttggggcacgtactaaggtctgacgctggccaatgacagcgttggtaacagcccggagttccggattagtggaagaaaactggtttctggttggtcctggcctgaaatacgggaactaaggccaggcttggtcttttttggggggggcgggggggcaggggggaggcgtgggaggaaggggctctggaggggaattgacggacc

SEQ ID NO: 138080 - DNA, 1051 bp, Homo sapiens
tacccagtaagccggccagaaggagggagcaaaaccttttctctctgcaacatctttccagtttcctctactggaaaagcttcattgccagctgacaaaaggaaaaatacttaaatggatcagatccattttcacagagcagtcaataatggtgaatttggagatgataagcaacaaattgatgaactggcacaacttccctgctactttcttgattgtaatgcctagatagggaataggaaagttattgaaatgtatgtgttcccatgaaatgtgtttatttgttgttcaagatcaatactaataaatggggactaatgttctgaagtattttggaacaattagaatcaccactcttaaccctgtggccaaagtcttaaatggacagggaggaaaatgtttataaactgaagcaaaaattgatctacatagaaaataaatctggagtatttacttggtaggtatactagtttcctagggctgccataacaagttattacaaactgggtggcttaaaacaacagaaatttgttctctcacagttctaaaggccagaaatccaaaatcaaggtgtttgccaaagccatgctctaggggagaatcctttgcttcttccagcttctggtggctcctggcattacttggtttgtgagagcataattctaatgtccgcttctaccttcatatggccttctttcatatgacatgtcaaatcttcctctcctttttcttataaggacaccagtcattggatttcaggctcacccttaagccgggatgatctcatctccagaaccctaacttaattacatccacaaagaccctatttctaagtaagatcatattcacgagtactggggttaggacatggacatctttttggaggacacaattcaatccaccaacacatttttattttactttggtctttaaaaagaataagccgagttcagtggctcatgcatgtaatcccagcactttgggaggccaaggcgagcagatcacttgaggccaggagttcacgaccagcctggtcaacatagcaaaaccc

SEQ ID NO: 138081 - DNA, 1048 bp, Homo sapiens
ctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagtcctttgaaattctgatgagctaattagtaatttacttctctcgaaatagccctttccagcatgatgcagtagaaagagtaatactgtgagggtcaggaaacttttgttctaatcctggctccttcattaattgtacaactgtggaaaaatcaccaatttctttaagctttaaaaaaatatctatacagtgagtgtactcctagctgtaaaattctgactgtaatctttagttccatcccattacttcttccatttaaattttcgatatccattcaatgaagatgcaagtctcttatttctgttacctctttcaagatacaaatactcattcaacacatccccactccattttactctcaattgtcctatattttctctttttcttcttagtaaggtgctttatgaagcccctgattctttgtaggcaaatttcattttgtcttaaaacctgtttatcacccccaacaaaatctggctgtcacatgaagacatcagtttctctgcagtctttctcactggagattttacccgcagacacctaaagcatatggtagcttccccattgcccagcttccgcaccatgggcagcttcttcagtgctcacctcccagagtttccattgacactccttgcccctcaggcattattctagcagacagcttccaaatgagacacattggcatgattagatttcccaggctccttagagggtgattttccggtaatccctaaaggactaatttctagcaagttccacctgcgtaatg

SEQ ID NO: 138082 - DNA, 1297 bp, Homo sapiens
cctcgatctcctgggctcaagcaatcctcagccacctaagtagctgagactacaggtgtgcaccaccaagccaggctaatttaaaatttttttgtagagttgtggtctcactatgttgctcaggctgttctcaaacttctgagctcaagagattctcttgccttggtctcccacagtgctagaattataggtgtgagtcactgcttttggccacatggctgaaattttggaatagaagctgtaaacccctctgtgtctgcatatttatgtgcctgtaatttataaagatcttgacctcccatgtgagcgtgtgattttctaccttcagatgttgttaataaattattatattatttctaacacaataaataaaagcaagtaatgtttacctcaaaaaataaattatatcataaagttacttaagttaaaaggacctccctgcctccgcgctgcagcccctgccgtagccgcccctgagcccgccaccaccgcctctgagcagaagatggctgtgccacctacgtatgctgatcttggcaaatctgccagggatgtcttcactgagggctatggatttggcttaataaagcttgatttgaaaacaaaatatgagaatggattggaatttacaagctcaagctcagccaacacagaccaccaaagtgacgggcagtctggaaaccaagtacagatggactgagtacggcctcacgtttacagagaaatggaacaccgacaatacactaggcaccaagattactgtggaagatcagcttgcacgtggactgaagctgaccttcgattcatccttttcacctaacactgggaaaaaaaatgctaaaatcaagacagggtacaagcgggagcacattaacctgggctgcgacatggttttcgacattgttgggccttccatccggggtgctctggtgctgggttacgagggctggctggccggctatcagatgaattttgagactacaaaatcccgagtgacccagagcaactttgcaattggctacaagactgatgaattccagcttcacacaaatgtgaatgacgggacagagtttggcggctccatttaccagaaagtgaacaagaagttggagaccaccgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtatcaaactgacactgtcagctcttctggatgg

SEQ ID NO: 138083 - DNA, 1033 bp, Homo sapiens
gtggtagactcggggagaacttggtggcccctttgaggtgccaggtttctttttcatctagagatggctgcgagtggaagctgataatatgtaggcactttgtaaattcatattgagtaaatgaatgaaattgtgatttcctgagaatcgaaccatggtttcctaaccctaattgatgagaggctcgctgcttgatggtgtgtacaagctcacctgaatgggacttttttagacagatcttcatgacctgttcccaccccagttcatcatcatctcttttacaccaaaaggtctgcagggtgtggtcactctttcttttgtgccattttggggtggagaaggtagatgtgatgaaaccaataattcaggacttattccttcttgtgttgtgtttttttttgcccttgcaccagagtatgaaatagcttccaggagctccagctataagcttgggagtgtctgtgtgattgtaatcacatggtgacagcactcagaatctaaattggacttctgctgtattctcaccactcaatttgttttttagcaatttaatggctacattttagagtcttccattttttgtggaattagatcctccccttcaaatgctgtaattaacatcacttaagaaaacttgaataaaatgttgaaacctcaaaaaaaataaataaaaggacctctattctgtatggcttacacagataaataaatgcttatataaattaaatatttctaaaattccaagaaattaaggaaactgagtatttaagattttcagtgtgctaaaaatgcatgcttgaagaatccaacttagaaacattttacaaatcatagcttctgcaccattgaatcatgcttgacaggtggagagctccaatgtggtggtccctacagctgtgcaccagcctgcatgttccctccctatactgcaggttccccttaacccacagcaactccccacatcagtttgctggtgtgtgtcagcacaggcgggttttgctttacttgccctgccagcacgtgggagtgccat

SEQ ID NO: 138084 - DNA, 1598 bp, Homo sapiens
tatgcaaatatggaaaatcttttgtaagttatcttataatatctggtacagtacttttcaagtaatttttacataaaaaatatcattattatagaaacaaaatatgttattttccaaggactatattttgtttacatgcatagtcctcattaagaattgctgatacagaataaatatatgtcatcctttaagtatttactttgtgcttcttcatatttgaaataaaaagtatttataagtgtttctgtatttattgtttcaaatatctatttgtagatatttccgtggacatattttagttaatctcatttcttagaatgttttctcataatgtgatatttagcaggcttctttcacaggaaaattactttctttaaatgaagtattagtctttctgtgaaatagatataatccagtgtaaatatttaggggaaatggttctaaatttacagacagaatcttgtttttcttttcactatacttacaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatg

SEQ ID NO: 138085 - DNA, 1035 bp, Homo sapiens
tttttttctgctgactaagatctcctatagagagctacaacaatgcccaaaagaaaggtaagtgaaatggaaagacagacggggaatgagctgctgagttacctatttcctaataggaagaatttatttgtttgtttggttttttttaaagctttttggcttcttccattttgtgatgtaatgaaacggaaaggggtagaagggcaaagagcagtcggtgtaaggtttaggatggtcttgcatgcaactggtagttcacttttggagtgttctgtttaaggagagaatctcttgaaaggtgtctccatgctgaattacaaacagccatagcgctgggctgtcgcttcctaccccaacccccttcctccgcttaccctattggagaacacttctcccaaccatacttcagtttcctcctctgccaccggcttttctcggggaaccgtcccgtctggggaacgaaagccatggctttctcctgtatttgcctttgttcttcccgttttcttttttcttttttttttttccttccctcctcctccacttcttgtcaggccagatggctatgcaatggtaatcctgtgccattaggcggcgcagacttcaaactgtcctagagaacagagattcaccgctgtaattagaaactttaggggtgagaaagctggacctttccaagctctttagctaaagatgggaagattataaggagacagcgtcggataaacttgctgatgttggggtagcatggatttgttcactttagtagtgcagaattgatctgagcctttcgagctccacaggtcttctgcaaaccctcacttcacaattcctggctcctcgcagacaggaaacaagttcacgctcggcgtttttttcttagtcccctagaagtgaaatcgaacgctgtttcattgcttggtaaaaccgtataacactatgctaagacattatgattgtttttggattattcctataaacaactccgccttccttattcctaaaacataggaataatactgaaattcccccgtg

SEQ ID NO: 138086 - DNA, 1685 bp, Homo sapiens
ccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcggtaaggagagtggggagtccacctttgttgttttcctacacaccagtcctctgctgccccagaaccattaaaatgcagaagttcctctggcagcttctcctttggaagactcatgcatccccgatcccacccttcttcttcccttttttccctttgttgcatcgatttcatttttttttttttccacatagagttcagctttgtttgcttcgtgacgttggggggcacatttctgctttgaaggaaaacgaaagctaccaagttttgggagatgggagatggtgctatacggtctttagggttacgtgaagtcaagtaaaatcgcacactggtgagtttcaagagtgagacatttgatgaatacgccctaagtactgagacaaggaggagtgcacttctgtaaaggatgggggtacacatgctgtaactggtggggattgagtggaggcctaccgaggcattgtaattattctgggtgagtgagaccctggtaatagagttattttgagagtgtgtagaagaaagtggttaacttgagcttgaaggcctgttagaactagacaaattgggaggggaagttggtaacaatgacgtaaatttttttttaacttaatatgacacgagattcagttttccccccatattgtcccttattttgactgtttctattctttcaaaatattttacttttaaatttctctcactgcttcaagtatattgagaactggatagggagctcagtggcttcttgtgtagtggcagcctgagttgctgctgcttcaaatgataggactttctctttcatggattcacttactcttaatttagaataacaaattttcagcagctgtcgggagaatatgataaactggggtgcaagatgagtgtatatccatgataaatgaaagtgcttctgctttttacaactcaagagaaaggcagacagtggcaagaacagatgtgtgggttcagattgtagggtataggaaccccttccctcttcttgagctttagagcagcagctaatccaggttgttgtgtgtttttattttttggcttgtttatttacacctgagaggatgtggaatggaagtggaggttatgttaaatcacaagaaccttgatatttgaactttgtcttctctggccaccatgtgtggatatgtttatgcaattttggaatatcagaaaatttaatcttacattttttgaataagtttaggttaaaaaaaagaacaccttttatatttcctttggacctaattttatgagcctcttgctttattattttccatacatgttgtctaatatttcaaagtaaaatttgagttgctcagagtctcaactcaatccaataattgtaaagtccaacttaatgcctttagttaaacccctaatgagactgaacagatcaggcagttagttttgctttgggagtcatacagtttcaatactgttatttattctttgctttctccttcctctaccccttctttaaaagtagattcaacaagaaactgctttcag

SEQ ID NO: 138087 - DNA, 1055 bp, Homo sapiens
actgattaaaaaaaacttttttttgtagaaatgggatcttgctatgttgcccaggctggtcttgaattcctggcctcaagtgaccctccagtcttggcctcccaatgtgttgggattacaggtgtgaatcactgcacctggccaaattctttagtcagtaattccctaaagctcaagtattgggagttgttcattcatgatagttgatagtgttataaatgaagaaaattacatgacatggctaatgtaatacccaatgcaatgctttaaaaggttcaatttccagaaaaattttatcataaaactttgaattatactgcttgttgttgtagaagaaatatcactgttttagaactctatacttaatgctgtgactttttaatgtagtttactgctaacttgttagaaatctttgtcatcgtcagtatgctaatcaaccaggaaaccctgtgttggggcgtaaagggccttagggaaatgggttaacctttgtttcatcccattccccaaccccagtcaccacgtaagaaagaaatgaccttaactctacttcctaggaatgctagttagatttttaaaatgtgattaatagcaagagctttgaatttctttgaaagaaaggatttttttttcattagcagcccaaaataatttgttaaaactctaatgtgacttctttaaaacacaatttataatgtcaggaagacaagctgaggcacaagttacgtgcttaacccaaaaccatataattggaggcaatactaagagtaaatcaagaatagatactagaaggcattatttcaggtcacaattaccctgtgagattaagatggtttgtatttactaacttcattgtatacaaaaagtttattttgagcctcacttatgattccactgcatttttcttaaactacatttttggatatggtataataaatggattatgaatcatcctttgttcaatcttttttgttgttgttgtttttgtcaatagtcttttctccttctttttcctcaactctggagttgggaacacttttttttttccccctaag

SEQ ID NO: 138088 - DNA, 1098 bp, Homo sapiens
ccggttggactagcttgttttagtatatggcttcccactggatcttaaacaggttttagccacatttttggtaagcagttcagcatttttaaaaatcagtgggtaaaatgagtatttgaatttctacaattttatttcctgtaatttatacttactactaatattgataaaattaaaacaaacaagagaaaaaagcagttctgcttacacaacatttgagtaataacacaagacattagagttcttttttcatacactttactttcaataaggattctatgttattttcttttttcaacttgaatactattagatttatgtcaataagtgattctctgaatcaggatcaaaatgcttatggcaaaaacatgttcatagagtgaataaatgctttgcagcttgtctatactttaaaatgaggccatggtttacttttcgtcttttggtaaatatatggagatttgcttttagagtgaaaataggtaaagatgtaatgtggatcacaataattgatttcacacataaataacccacttaacaagagagtgatgaaggaattgtattatcatccctggagatggaagagttcagtctggcttgatggattatttttgtttttttctgtttgtttgtttgtttttttatttttctgagatagtcttgctctgttacctgggttgttacccagtggcatggtcatggatcactgcagcctcaatttcctggcctcaagcaaacctctcaccttggcctctcaaagtgctggaattacaagcgtgagccactttgccaggcacttgatggattcttcaagcatccatgactcctatttttaattgaattgttatacaacttaacacccacaattttctgttcaaccaggtggtgaaattacaggttttaatcactcaacacaacatttgatgttcagatgaccttccctttcaaaaatctgtaagacaagagctggacactttataatagtcaaaataacttgtaaatggtagatgttggcatacgattttttattgatttcttgcttttttgcacatcttgtgagcagtggcactgactgcttttgttctgtattatcttttc

SEQ ID NO: 138089 - DNA, 1054 bp, Homo sapiens
tggcagttgttctcagctgggcagtttggaccatgtttttttggcttgtgtctgagagtacattcttagtgctttctggtatgttcatctggggcacaccgctgtggcttcagactagttcttcttcctatggcaaataaatttgttttggtgggtaaacaattatctaagttgctaggctcccttgaaaggaaagtgtttaatttcttttgtaatgaaatcttatcactttaccaactatagaggaaaaagcccagtgctacagctaacatagtctgaaaaggtagtatttgcttttgttgtgtgtgttttctttagtcatggggagcccttcaggtatgatgattaccatgtggacccaccatcagtgacagatgtttaacagttattttcccagaccagcctagagagggtgaccagggaaatgcagtatttttgtgtgtgaaagtaacttgatcaagacttatttaccaactgagtgtgcagccttgaagaggcattgatgtaaacagattttagattgttaagcaacatttattaatatacattgctttgtggagattcttacaacttctttcttaagttttttttttttttttttgatatggagtctcgctctgttgccaggctggagtgcagtggcacgatctcggctcactgcaacccttgcctctgggttcaagcgattctcctgcctcagcctccccagtagctgggactacagacgtgcgccaccacacctggctaatttttgtatttttagtaaagacggggttttatcatgttggccaggaggttctcaatctcctgacctcatggtccgcccccctcagcctcccaaagtgctgggattacaggcgtgagccaccacacccagccacaaattcttttaaaaagcaaaattgcaatcatcctatgtttgtggaaggccatttacactcttttaccctgaatagactgtaactgaaggttagttttgaaatgggtggctatgtttaatttttcagtgtgtgaaaaataaaggcatgcctatttgtctcattatatgaagtta

SEQ ID NO: 138090 - DNA, 1083 bp, Homo sapiens
agagtgatgccattagcaataggtcagacccctgaataattttctgttttgctccccttctttcactttatttatagttcagttatttatggttgccactgtaataacacttttgagtttaaaaaagccattgccttaaaatatttttgttgtattgagagaaaatttggttctaacaaagagacgttttactgggatgaaaatacagaaaggcctatggagaaatagctttttttcccattggaaaaataaagggaagtggagaagtacatttatttcaacctagaatcattaggagttgcatttctgagaattttcatgtgtgtttctatgggtattattagtcttcttcatagaatgatttgggggactttcggagattatgtcaataacttccttactcctcattatttcacaatgtttttggttttccccctttttcagaaacaaatgttggtggattttcacagtgaacactagctaagtacatgagtaggttttgagtatagggattgaggttcagatttatttaacttcagaacgttttctactgcttcagatttatctattcattgagagagagaatgcttttgcatttgaaacaatttaataggtgccaatctaagaaaaagagcaattttacaatttggcaggatgttctttgatgggaattgacttagcgctccagaaatatattgctccacagtatttaactgccagtcaactttcttattagattctcttactttagaagctcctttttatggatcattatcaagatataatttcttactttggtcagccctttttctgagcagaacacttttggagttttgctgtaattcaataaattgttatgtcttcttaagtttctcagggagaaatttacagtttcccagtgatccttcaaacatttactgggcatacaaagtagcctatcttgtttctcagagccccatgatgtgagtgaggaaagttattaggcttcattaatgcttaggcatcagcccagcgtattgtaaactacttggctgatcgtgctacctagcaactatattgctttctttaaacactttatcatcc

SEQ ID NO: 138091 - DNA, 2370 bp, Homo sapiens
aaaacatacaagtaatattgattcatcagtgcacagatctaatatattcaattattttcctaggaaaacattttgttctagatatatgtctcatgatatcatgtgaaagttttttttttttttaactccagaatttgtacttagtttgtggcattttctcattactttagggagcaatggttgcaacatactctgccctgactcacaagacctttcaaccagtcctagagcctgtagctgcttcaagcttagcccagcgacggagcatgaaaaagcgaacatcaactggcctgtaagatttgtggtgttcctaggccaaactggatgaagatgaaattaaatgtgtggcttttttcctattcttatcaaaggcatcgttgtctgctaaattacttgaatattaagtaatattaaatccccatttttaggggaagtgagatttaaaaaaccattcacaggtccacaatattcatactatgtgtttgcagtagtgttcaagtgtttatttaagcatataattggtgtccaccaggtcctcacaacttctctgcacacaagcttctaaaattcctttcaaataaagttactttaatattttttttcttgtttcatacaattatggtttggggagtcattaccaacaatcagtatacatatataatagtataatgacaagcaatgttagtatttttaaacatcagatcctgaaggataggctttttctaatgaaagaaaaacaacaaaaacttattataaaagcttgttattccgtaaaaccaaaggactccattcatttgactcactgtagttactaaaatgtaaacatagtggtttggtgccagagcaaaatacatttgtgctaatatatgaattcttgatatagttggtgccaaagtttttatagaagaattatatctcagataatgtgtgcaggcagatctgtatattatccataataagtggcctcatttagaaataaaggtttttataaggcttctgtaaattttacatcatggaaatttagtacaagtgaaactttttttttttccaaaggctttatactgttggtgtaatcttataaataggtcatagttaagcctttgaaaatgaagtatgtggtgttgacactatcctggtgttatataaactgactttcaagttaaccaattggattgtaatcatcatctatcccctttataaatgaactacactgttgtttttctgacttcgatgtgctttgaagtacagtgtagcatatcattctaccttgaatcctatgataatacagttgacatcttgctgtagtggacttgtgcatatagcacacatgatatagtatattgtattacagtaaactttagacaatgctacttaatcattttacttcatgaagataaactaacattttaaatatgaataatattaatggtctacaaaaaatttgagcacattttaaaatcatatttataaaaaactggccaaattggtcttatttaatgtataattcagaaccactgtgtagtatgtattcttttctctaaatgatgaaatgctaaagaatcatttcacgttgttgaagaaaataccgttgctacaacaacagcagcagctactactgctactactactactactactactactactactactactgacagaaagaattcatgaatgtaaactggaggatatcacagttttctttagtgaatataagtgaactacttgtgcgtgttaggtgtactatttgctatgtattttattttgctttattcagagagaaagttgattactgagtgctgaattatacaatttaggctaggaaactcgtaactttggtatttaataaaagaaactatacatattctgtttgtaatgtaaataatctataccccatgcacaaatatctgtttcctgggtgtgatatattaaagtatgtattcttattttgaggtatcttttggaaataattgaaagagattaaataacaatttatgccacatgaaaaataattacttagaagtagttaggtatcatgtcttatggctttttatgttccattttggctttttttctcatttgctttattactatatgtacttgcatgtaacagtttgtaagcatatattctgacttattttccttctgtcattatctagtgctgttatgccttcctatcagaatcgataagtcaaactcagaggtgtgattttggtgttgaagttttcaggacagagatactatttccatggatgcattttaagtaataaaattaggggaagtgaaatcagaaaatgaaaaatgattacaaaataactttcaggttttctataatcaatggctttaaaaagtagacagtcttaattaatt

SEQ ID NO: 138092 - DNA, 1006 bp, Homo sapiens
tatggttgtttacttcaaggaggggggtgttgagtagggtcttagtccattatggactaagtctaaacttagtttagtttgtaagtcaggaactgttcttatatgttatgtataatgctaagtgatataaattatggcatgtccaaaagtggatctgagaattgagcttagatatattgagattagaaatggttaacaaaactagtggcttttgagacaatagaaactggaacatctatctgacagacataatttcctgtgtatattttaggctattaagcttgagcaaaatgtcattttcaaaattttgtaatttggaaagtttctttttctcagatatttagttaattatatagatataatgttttatttctcagatatttagttaattatatagatataatgcttttttcctttatattcaaggttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggtattccttaaaaacttcaccatttgcctttcattcttttcctttagttgaatctatatgatgccatatgaatgttatggtaggcagataaaagctgttaccttgcccttttcagttttaaagttctttaaatcagggaattctcatagcccctaatataaatatttacactggtaactagcatctaaaaccaaccagaatgtaataatcaggctattctattctgttgggttatatactaatttcagaatcatatcattttagagttgggaggtagggaaaagatagccacagcttcaatatattatgtattctaaatgatgaaactggctcgaggtacttcaatgacttattcaagacccagcattcacttaataacaaagctaggatagattcatcaggtatgttaaattgtact

SEQ ID NO: 138093 - DNA, 2669 bp, Homo sapiens
ctcactcatatgtgctgagtatttctccactgaatacttgaaggagactgtctgcatatctacagagttctctttgtgcaattttctcttctctaatactccatcctgtgaattttgtcctccttctctaagactctctgttctggcttatctactcaggaagtctttcaggctccacctgacttagccctccctgtactaccacttggaaactctttccaggtagtaagctaaggcagttgtggggcatacgtcatttgtcccctgtctctcagtattcagtgtcctttgttgcctgatgtccaatgtcttaaaagtatcatttcatacgttttgtcctgtgttttagatttttcaggcatgagattaaatcctgtctttgtctgcttcatttttctttaagtagtagtctgggagtagcattttaattgggtgatagtagttcaatgtcttacttccagaatttacagtgtagaatgtgggagagctactgttgattcccagagctctggaacttgctgtgataaaggaacagtgtgtttctggtatgctagccagtgcttaagtggctaaggtctctggcttatatctgtctacctccagtgtagaatgtgccatgcgtgagcatagggtgtgttattggtatattattaactatagaacataattcaatatctgaaaaggattgtctaggacccccttctaaggagggtctttaaaggaccttgttaaaaactggtaccaaggcatagaaggacaacagtataataaggctccattattcatgatttcttgcgttagattttagaagtgtcacaaatatgtttgagaaattcttgtagtcatttctaattttcttttaaactcttcagacctccattctcgatgtgggactatctaaacccatactagcacagagatgcagtcagtaagttttgattcctaagtctggaatattaggtaagagcaagcattttaaatgcgttacccaaaagatgataaattagtacattgattgagcagccttttaaaaaatgattcaatggttacttctgtagacagcttattaataattagatgtttgttggttatacttcacttgtgtgtacaaaaaattgttaatccaaaatgaggacatgtttttataccttagaaaaagactttttaaatacatttttgtatgttttaaagaattttataatgtatgtcatttgtattttaaagggaaagatacctacccaaatttcccttcctcagaatgtacacacacacacacacacacacacacacacacacacacacaaatacacaggtaaacaaacagaactcttaagctgtgctctattttccttattcaagaaaatgtggtagaatgaatggctgattattgtaaagctgtcagttcttctaaaattaatttattggcttaacaaaattccaaataaagccacaatagggatttttgtttgtttgatgttgacagaattattttatagtttccttggaaaagtaaacaaatgcaaagaaataatatttttgtttgtttgttttttgagacagggtcttgctctgtccccaggctggagtgcagtggcactatcctggctcattgcagcctcaacctcccatgctcaggcaatcctcatgcctccgcctcccgaatagcttggactacagaagcgtgcgccactataccaggctatttttttttttcagtagagatgggatcttgctatgttgcctaggctggtctcaaactcctgggctccagtgatcctcacgcgttggcctccccaaattctcttgtttaaaacttggtaatgtgcataagcaaaacattatagtatcaacacaagattggaaacatactgtatagcccaaaaatatcctgttatagattacttaccctatatcattatgataaaggaagaatcacaaattgtggcaaagaggttgttcaataaacagtatttgagaaattgcttaaatatttccaaaaatcattttaaaatgccatctctaccatatacaaaaataaatcttacttacataaaaaagctaaatcttgaaaaacaattaccctataataaaatgcagctaaatattttgttgaccattggatggagaatgtctccttaaacattaaaataatgaaggaaaaatcatacagaaatcatcatacatttgactagcaaaaattaaggattactgaacatcaaaaactagcacaaaattggataaatatttgcagctaatatgatagaaaactgacatttttaacatttaagtgacttgtaccaattgacaaaacagtaagtcagtaatagaaaataggcacaaacattactgataattcacaaaaaagtagaaagactactaaacatgaataacaatgttcagcctaaaaatcaaaacttaaatttaaaaaataatgccattttcacacatcaaatttgaaaaggctttttacagggtatattccatgctatcaaggatgtggtaagacagatgctttcgtaaactgctgatgggagtggaaattactataacctttttggaaaataattttatcgtgtatgtcaggaatcttggactatttatgctccttgacccagcattccatttttaaaaaaaaattcttaattcattttgagaaaatgatcataaat

SEQ ID NO: 138094 - DNA, 1685 bp, Homo sapiens
cattattggaaaagtctgtcttttcttcactgaattaccttacatttttcttgaaaaccagttgatcatatatatgaaggcctatttctggatactctgttctgttcattgatccatttgtctatctttatgacaataccacactgtctgaattactgtacctttataatatgtcttgaagtgaggcagtgcgagtccttgagctttgcttttctttttgaaagtttggctcttctaggtcctttgcatttccatatcaattttaaaatcggcttttcactttgtacaaaaatgtcctgctgggatattggttggaattttattgaatgtataggtcaatttgcagataagttacattttagtaatattgagtcttttaattgatgaacgtggtatctttctcaatttatttaggtcatctttaatttctcgcagtattgttttcagtgtaattcttgcaattcttttgtcagatttacctctaagtaaatcctgtttttaatgttattgtaaatagaattgacttcctaatttcaattttaaattggatggaaacacaaccgattttttgtgtattgagcttgtttcccacagtctagccaaacttaatacttctagcagcttttagaaatagatttcaaaggttgagaaagttttctgtaactatttttgagagttttataaaaaatcaggaatcaatttcagatttattcaaatgctttttcttcatttattgagattataattttttttagtcttactgtggtgaattacatcgattgatagtcagatgttgaaccaaccttgcatttatggatgaaccccacttagtcttgatgtattaccctttttataaattgttggacgatatttgctgaatatttaagaatttttgcatctatttttatgagggatatttatgattttcttgtattattatgtctatttttggtattagagtaattctgactccatagaatgagttgggtgtagtttttgcctctttaactttctgggaaagtttatgtagattcaatgataaattgcccttaaatgattgatagaattcaccagtgaaggcatctgaacctgaagtttttcttataggaaagtatttaactccaaaatcaatttatgtaatagacttgggttatttatttttgagtgagctttgctaacttgtgtcttttaaggaatttgtctatttcatcaaagttatgaaatttattggcataaaaatgttcataatattcccttattgtcctttttgtagttgtggaattgttagtgatgtcactgctctcacttttgatgttggtaattcatgtttgctctgtttttgttctgcttagcttcactagagatttatcaattttattactctcaaagaaacagcttttggtttcattgatttttctgtattctatttctgttctattacattgttttctgctttaatcttttttactgcttattttatgtattagcttttctttttctggtttttaagatgggagctgaagttattgatttgaggcctttcttttctaataatgtaggtgtttagtgttataaattcccctctgaatactgctttagggtcatctcacaagttttgatatgcatcatttttattttctctcagttcagtgtactttatgatttcctttctatttctttgaccc

SEQ ID NO: 138095 - DNA, 1049 bp, Homo sapiens
ctcctgccctaaccctactgaatctgctttctgtcactatttggtttgtactttctaggagtttatataaatggaatcatatagtatattcattttttttgtctggcttaacataagtactttgagattcatctatgttgtatgtactaatagtttattcatttttattgatgggtagtattactgattgtatggatacatcatgatttgtttatcattcacttgttgatggatttttgggtcattgcagtttttgatattactaataaaactgctataaacattcatgtacaagtgattgtatcatatgttttcgtttctcatgggtaaatacctaagagtataatgactgggtcatgtgctaggtatatgtttaacttttaaagacactgccaaactgttttccaaagtgattatataaattttacattcccaccagcagcgtaagagagtttcagttgctccacatccttgccaacatttggtatggtcagtcttttaaaatttttgaacattagattagtttttagtggtatcccattgtggttttgaattacatcacactaatgactaatgacattgagcatcttttcatgagctcatttgccatctatcctcttggtaaaatgtctgtttaaatttttagcctgtttttttttattggattgtttgttttcttattgagttttgagagttcttcatatattttggatgtaagtccttgatcatatatgttatttggaaatattttcttctggtctatagtttgtcttttcattctcttaacagtgtattgaaaagcagaagttcttaattttggtgaagtctgatttataggattttttccctttattaattgtgtttttagtgtcctttgtaaggcatatctgcctaatcacagctaaagattttctcttatgttttctagaggttttgtagtttgcattttacatctagatttaggatccgttttgagttcattttagtatatggttacaggtatgtgcagaagtccttttcatttgttcacatagatagccagttgttat

SEQ ID NO: 138096 - DNA, 1016 bp, Homo sapiens
gttcagtaccaggtcatctattttaaaaattttcctttctatagtagtatttatatgcattatgatttattaaatcataacagtttttttgattaaaaactaaattaaatctaagaaaagtgagaaaataataatgtaaattatagaataatttataggagaaggtataacttttttcatttatttttttaaattgacaaatagttgtacatattcgtggggtacatagtgaagtttcaatacgtataatgtatggggatcagatcagggtaattttgcatccttcaacaaatctctcactatctctcccttccctctatgggaaggcatatgtttataaaattagagaaaatgcaaggatataagtgtatgctggtgtgtttgtgtagagcaagaatgactagaaatgtgaattttcctttttttttttgttcaattttctattaggtttttcttgttagaaagaagaccggtcctgatgctgggcagctctatgcaatgaaggtgttaaaaaaagcctctttaaaaggtagaaaattagaaagtttattaaaatagaatttgacaaagtgtagtttaagaaatatgctgtgtattacttgcataaggtgaatagatgtagctatttttaacattggtatttgtggcagtttttctaacctgtaggtaatattactagatttgatattggcatatgccttaacttagtgagagtgcacccccgtaaaaatttgatgctagaaaaagtgacatatttcatttaatttaaacttattaacttaattaggatatattctcttctttcaagattcttggtttttccttttctatctgtgtcagtattacatattgagaaagcacaaccatttgcacacactatcttttagggtgtgataaaaataccgcttatgatcagttttaatcagtaaactcatttgaacaattaaaagagattaataggccgggcatggtggctcacacctataatcccagcagtttgagaggctgaggtgggc

SEQ ID NO: 138097 - DNA, 1067 bp, Homo sapiens
aaaagcatgacataagggtctgtaagtccttttctagtaggtcaaaaattagacttaagttttctagcagccattataaagaagctaatatatttgagtgtattataattgacagtattttaaaggtggaaacggattaaacagaccagagaaatttctctcatgggttttcttaaagaaaatactgtataacataatgaaatatattcaataacatcatgttaaatatagcaacatgatgaaaagttgtcaatgtagtgcttaaattcagggaaatcttagctttgtctgtgctgggatttagttttaagaagaatatcattgaaaccttttaattcctaatattaaagtacaaaatagtgatctttatgtagttcatcaaccaaagaaatattaaggaggtggcttttttttccccctaggatatgaacatacttgcttgtcagtgttacatcatttgcggaggcattgtgtaggtgtgacttgttatatgctgaacctattcaggaatttggccaaggctgtgaatcagataagtgtaggagcaattccaagagactttgagctgcagagtcttaagtttttcttcaaaagttccattgttaaaatgcagtaaatgggattttagcccatataaagccttataacattaaatgtttttattgtctatttaacagtgggggaaccctgctaaagtcaacttaaaattgtagtttaaggaagcatgcattattatcatgaaaggtgcatatacaattctgtcctaagcacaccaagtataatgctattaatgatcattaatgtatgggttgaaaggtatactaaacaacttacattaattattttaaaacacaaacacatgaaaatacctttgaaattgtctgattagtcgtccttatatatcatgtgccaaataatatttatataaaacatacattttaatatttgtggattataaaaaaatacttttgcttttgtgatagtaaagactttaagtacaggacttaaaaatgaatttttgaaaatatcgaatacttgtactcttaaataagtgatcaactctcaag

SEQ ID NO: 138098 - DNA, 1110 bp, Homo sapiens
gacttctgattttaaatggaactaatcagaagatgttgaaaatggattcaagtattgtttggatttctttttacaggatgaaggagttgttaaagaaatccctattactcatcatgttaaggaaggctatgagaaagcagatcctgcacagtttgagttgctcaaggttcttggtcaggggtcatttggaaaggtaatgaataatttttttccccatttgttcctcttctaaacatttagcaaaaaaagtgaacacatacgtagaaatctgattaatgagtcgtttctaaacttctgaacggatgctcacaaaggtaattctttaattttattcctttcatttctgttgtacttttattaccatttctttgtacttctctgtaacaatcaaggttttccaattccctaggcttactgatttcttgagggaaaaatatagcatactctttattagctgcctaaatcaaagtagcttgatttttgtaaaaaatggtattcctatctccttgttcccatgctggcatgaatacagcttgttttctcctggtgatttaatctacatttgttagctatgacacagaaatcagaatttatgtcttaattcatgtatgaattcgtctgtcatctgttaaagtagaacaagggtgtgtaaagtagaacaagggtagttactgggtgatatgtggtttatttaagtcttcagagagcttacatttcaaggcagaaagcaaaattgagtaagaataactattatagtcgttactaaagttgtttattaagcacttaataacatggttttagaaaagaagtgtataggtctggttcctgacctttatatacctaacatctaatacatgaaaattattgcatacacatagtaacagcctttagaaaaacagcaatttagaaaaaccgcaatttaaggggagaaagataaagagaaactactaatttcaagtggctgagatttagttttaaaggggaaaaataaggcaattgagcataggttatttatagtgctctggaacattttaaaataaagacatttttattttattgggttttagaaatggggtcttgctctgtcacccaggctgtagtgcagtggca

SEQ ID NO: 138099 - DNA, 1038 bp, Homo sapiens
ccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgagttatagattttttaagctggaaagaacctcagagatattatgtaatacttcattgtatggattagtctactgaaacttggagagtctgtgatttatactaggtgataaaagtagctagtagcagaatcaagacttagggcagtatgcttccttttaggtcagatatattatgtagacctgaagaagtagaagatgaggagaacattatcctttttctatttggttgtggatgaaatcaactttgatgacccctccaccaaaacttgttcataattggaattagctcagatagaaaccagcagagggatttaaattgggtttgtccaaaactctcctttgaaatgttctatgtaactatttctgcagttagtaaccatgtaacaacacttttaattttgattgacaatatgagagatacaatgttgtctttgtagcttttgcagtttactgaatattaataatatattgtaattttgagtataattaaatgtaaactatcaaaaccattatctagagatttgtctacagttcatatggactaataggcatagtaatattaatgttgccagtttataaaagataaaggagtataaggaactattaaaggcagtggagaaggagaaggctgcttattatattttagcattaataaattcacaaggatatcatggcttacaccacaggggaacagtgtgtgtggtgcataaactcaaggacacatacacagggtgattggcaaatatttacctttataattttagtagaagataagtcaggaagttcagtttttagtggaaaggcagtaaaaatatacagtgctagttact

SEQ ID NO: 138100 - DNA, 1016 bp, Homo sapiens
ctgttgtagtgcaaaagcagccatagataagatggaaacaaatgggtctggctgtgttctagtaaaatttttacagaaacggacaagaggtcagatttagctcatgggttatagtttgtagaaccttgatctaagtcttctactttactgtttcttgaattagttgttaaagaatgagtagtattacctactgagctctgcatgttgacttgttttgtttccatgattacttacatctttctcctatagtttattttttcttctgtatagtatgtcatgatgtttaattaactgaatgaaagaggaattcacaacagtgcaattatataaaactgttcttattataatttgctttgaatatacccccatggtagatttctgtggcattttttttcctgtcataaatacttggttggggacaatttaatgaaagtacataggttatatacttagtgtatagttatctgttattgcaaaactctaaacaatatgaaattaagcataaagctctgaaaatcaaagtttctcaaggataatctgggaaccatgttaatagtgttccttttctaagtacttctatgtgtcctttgtccttttgtttttcagtaagtgtggatcttgttagattgtggaaggaaatgcctagggttatatttttcttagttatcactcttgttttaatacttttgaacctcaatttttgaacaatgtttttcaggtaaatggtcttaaaatggttgatgagccaatggaagagggagaagcagattcttgtcatgtaagtatttatgttaatttattaagccacatttttagcatataaggaaaaagaatacagggaaaggagaaaagctcctatcaaacaaatatattcaggtaagttggtaataagcaaatggaattattaataactcaactgcagtttaaaatataggacaggttttcctgacagaaatacttatgcatgcatttttaaaaataaacagctttattgagacataatttacatgctattg

SEQ ID NO: 138101 - DNA, 1036 bp, Homo sapiens
tcccataccacctccaattccaaggatctgaaagggatttttttttttttaatttctcagttcagttttccttgatgagttgctttggtcaataatagtaagaaagcgataaatttgaagtgacctatgtgattttctgggatcagatgagtacagcaactcagtttaggatttctgtttgtcccgcatatttgtaagtgctttaagtcttttctgataaaatgtgaaaagaatttttaaagtagtcttctctaagccctggtacgagagtctgttcacttggattttgaaatatctgagtaaattattactacctttattgttgatgataaacattccagaatcatatgtagaatttttttcctctcatttggcacttaattggggaaagcagcatgtctgcttatcttttcaaattacaaattttatttttgaaataaagatttattatcccagagaattcagaaattatttttgtttttatgtggatgaaagtgatttaaattatagtaagtatcaatgagtatacactgtggttctccgtaggatgaatattcttatattgaaaacctgataccttgagggtagatgagatgggagcaatggagtgttctgtttctaaaggccatttctgactgagataatttccaggatagagtgatcttcttgactcattcacattcattttatttctagttccttcagacccacagcttcatgataaattagtcataagatgatatgaataggaagtaaccagtaactaaggtaacagaggaaagcaatatttttctttttttatggataatcctcttcctatgcataatccttttttctatggataattctgagagtcattttatggcaaaaatttaattatcacgattctgtcttaatattgatttctggactgttttccgaatgctcttctttctatatgcttacaatgaatctgtcacagttctttttttaatcccacatagtctgttttgttgagctaaggtggtagatggtgttatcatttaatgaaatggga

SEQ ID NO: 138102 - DNA, 1014 bp, Homo sapiens
gttgctcattttacagatgaagaaattgcaactaagaaagcttaataaacttttcaaaggcagtaaaagtagagctttagagtttgaatcttggtctgcttgacactgaagaattgctgttttcatgacatactatgcctgcctaatgaatgaaacacagcatcattcctcaaggagctttaagtctagatgcacatgacaagaaatttacctgatgtgatgtattactaatcttatttttagcattaaaattttaaattgtcttatatatataaatatatatatgaaacataaaatttgccatcttaaccattttaaagaatacagttcaaaagtgttgagtacattcacattattgtgcagccaatctacaggactgtttttaccttgcaaaactagaactccttacacgttacacaaaagctttccattctcccctttttgccagccccagcaaccacctttctactttccatctctatgaatttgactattctagataccttatataaatggaaccatatagtatttgtcattttatgactggcttatttcaattcatataatatcatcatggttcatgttgcagcgtgtgtcagaatttcctttctttttaaggttgaatgatattccattgtatgtatataccacattttgtttaacttaccatctgtcgataaatacttgggttgcttctaccttttggctatttgtaaataatgctgctatgaacataggtgtacaaatatctttttgagaccctgctttcgatttttttggttctataccctgaagtgggattgctagatcatatggtaattctattttaaatttttaaggaattgctatactgctttttatagcagctataccattttacgttgtcaccaacagtgcacagaggttccaatttctccacatccttatgtatggtggaattattttgaaaaagtaaattccaggatatattctggatttactttccatttcaacaaagccatgctgttgataatt

SEQ ID NO: 138103 - DNA, 1041 bp, Homo sapiens
tggagtagatgcagtgatgaatgaatgctgttggaaacaattacatttcaaacttaatgggcatatgcagaaaaccatatgttgattatagagacatatacaagaatgatagaacatatataagataatttgtgtatgattttgtactttattttacagatggagaagagtaactctagaccttctggcacaatcataaaacatttattgtgtttatcatttgtagagcaattacattggaataagtgaatacttatagaatctcttaagggaggtcagtcaatacggattttcaaaaaagacatggtcattcagcaacttcatatctatgaacaatattaatttgattttatttggtctttattcatgatattatgtgtatcagtagttctttcttttttattgctgtgcactagtctgttatgtgaatgtaccacagttgatttgttcattaataagttgaaggacatttggatttgggttgttaccagtgtttggtgattatgaataaagccattatacacatttgtatgaaaatttcggtttggacataacttttcacttatattgggtaaacacttaggagtgaggttgctgcgtgagaattccagctgctctgagtacttgccagcacttagtcttgtcagattaagtgaaaaaaaatagctattctaattggagtgtaggggtatctaattgtgattttaacttgcatttccctaatgacacatgttgctaagcatattttcatatgcttatttgccatccgtatatattctctgatgagttgtcttttcaaattttttgaaattgttcaagttgggttgttttcttattattgaattttgagagttctttatattccaaatgcaagtcctttattagataccgatttccaaatatttttcccacatggtctgtcttttcattctcttaataaagagtcgaggtttttcatcttagcgaagtccagtttatcagttttttttttcttttatgaattgtgtttttggtgttgtatctaagaaatcctagcctaat

SEQ ID NO: 138104 - DNA, 1488 bp, Homo sapiens
gaatggatctggtaaggctttgtgaaggaggtggaatttgagcagggcattagaaagtgataatattttcacagacagatgaaaggagcatatttcacgtggatgggcacaatataagaaaaggcatggaaatgttctgaaagaaggaagaatctgatactgttgtaagtctgtgatgtgggagaggggatatagtgagagataaggaatgtattaaaggtaagctaggcccaggttgaatgggactttttaagccagtttaagggttcaattttatctcataaataggagccactgaaggtttttgaggacatgagtgacattattagatttgtgctttgaaaaataattgacggtagtgaggaatgggggagatatggaaggtggggaattccagctaggaggctattgtgttagtggaagtagtagtgagatttttgaactagtacagaaggggtagaaaagagatgactgatgggagagacctggcagaggtagaatagttacaatttggtaactgattagatgttggagagtaaaaagaaataacaaacaattgagattagaagcgtcctggtaggaattaattcaatgtaacaggtatttaatgcatacctgccaatataagtctctgtattagccaccagactaatataaaaataaatagatctttgcagtatagggagatagaaagctaaaatgaaatctcccctttctaatattgtattgaataatagcattccactctgaaggtttctgatcgtgcttagaatgcttaaattctttactaccaaaggtgaatacacttattactagctaaaacatttttaattctttttaaatgggccttaggcctgtaattcttgtttcaccaatgttcatcttcagtagtcagcagccgtgagtacagagtcctattctgaaaataatgaccagtacttatttctggaatgtggaaggagagcagggacatctgtattttttctatgctttcaccaggtttatttggaatagacaagcggggaggagtcagagggcagtggcccctccctgccacaggtgccttctcagttcctccaagtcaatctttctttaagccagtctgatctggaaatattcaggtcagttccttcagggcaggtcctctatatttccctaccttgattagttcatcaagagagctaatcattacctctgtgttccatgataaggcctactgatagtgtagttgcttttctgggccatattgttttagtacctaccctctcatagtctctctcatctagaattttgatgaggaaatgcaagatttttttcccttcctgtaatttctttcttggtgctatcattgtatgtagcagcggttcttaagatttgataagcacttggaatcttgaggtataagcctttcagtactttgtcagaatttgctatgtaatgtttattcatttatgttatttccaaggattatttactgttgctgccaat

SEQ ID NO: 138105 - DNA, 1004 bp, Homo sapiens
ccacttagtacttagaagagtttgtttgtttttaattatattcttttgataagaagtaaacaagtttacttttgataatttatattttaattacaaatttgttgatgttggctttaaaaatgctaattttgagtacaagctctacaaccctcaattgtgataattttaggactaagagtgtttttgttgtagaatatatatttttaaaatgtgctagaatccttaaagaaaatgtaggtaagaatctgttaactttaatgtcaaaagaaataatttccgtccatttctgtgtgtgttgaatctggtaagattaaagattatagacactaccatatattttggagtctttttgtatcttttacctgtcttgcttgcatggacagttgttaacctttgaattatcattcagaagtgtgtaaattggttgtttgagactcttaacatgttttcccacaggaaaaacttattaagggtacttatatttttagatcagtacataatagcgaggtataatgatgccgagcctaaccactgtttgtaaaattgttctgtggtgaaatgtgtcaggtttcaaccaataactagcttggttccagtgagaggtagagaatgggcctgaaaaggggaaacctggaatcttttggtttctgggaagagagttcttagaagaggggaaatagggtaagcaagaaactgattgtgagagctcttgcagggactgtctcaatgaggtctactgggaataggaacttcaaagggcatcacccctcacgcagtcacaatttaagcttttgactggattctgtcaggatcaagaaagaggttttacttgagatgggatgggtattggtcattcctgggcaaggatcataaagaacaacctgtttgactaatgtgaacttttcatgatttaatgccatgcatgttacagtttgttcgcttagttgtttgttttttggtgaggaaccaagtgcttctttatcaagttgatgatgtaattttca

SEQ ID NO: 138106 - DNA, 1191 bp, Homo sapiens
gccacgccagagttgttgtgactaagtttcttcactttccgacccgaaggggaactgggggactggcggggtgctgtgcctgactccgcgcgtccctttttctccgccgcgcctagtttgctggctgggaacattttgggggacagctgcggactccagctcgctgttgaaccccggacgctttacgaacccagtgcaacaaacacaccaaggtgactaagtaactctggggacatttgcacataggcacgagtgttccctggtaacagctttctcgtttctctgtggcttgttatggttccttgtaatgacccatgtcgagatacactggcgacctatctccagtcgccaggtttcaggtgatgttctactgcttcctctcaggtccccttgattctactgcactcttgctccaccccttctcctttccacaaccgctgtccctgccccgttggtctgtaaaagaagacgcaaagtaaaccccagcccttataaataagtcgaatctttggtaagacttagcgaggttcaaccaaaatactttggttcacctctcttcccactcttcttactctgaaactgttctggttgggctttggtcagctgtgcagtgagaacttagatgtacacaggtgctttgtttttattgttgttataaaagcgggcagcatttaaacacaaaaacgtgtcttttgtgatagaaagttggatccttttctgataacttaatcgactgcgtactactccagtagaggccaccatacacctcctaaaaatagttggtgaaattgattcacagtaggatattttgaggtaagactctcaatcctcgacatctaaagggtgcaactttgtcttcaagtacttgctccatttaaaaaaaatacacatttggctgttgtatgattaccttgtttttttttctttaaatttttttgttatttatcaactaaactggggttaagattacatgctagaataacatgtggtaaggaatatagtggaaataaattcagaagtaccctaaatctgaaccctctatacttacaggaaatattttactagtaaaccaagcaattccaatatacgttttaatattttacatctcgtaagaacaagataaatgaataggcgttcctttcttgttgaaatgtgggaatgctaactgtttgcacaattgtctagcaagtc

SEQ ID NO: 138107 - DNA, 1087 bp, Homo sapiens
acatatgaaaaaaaaaggaaggtattttcttcttttcagccaagctaaacttattcacaagaaaatgagaattgcaattgctctggagaataggaaaattagcacatgcaaagaaaaccttaaaagaaaattggcctcttcatggaaactggggatgttttgtcctaaggtcagttatcaacagcaggatttttgtattgccattgcaagcatgtgatagaaatgtttgttattgttggagaagaaaaggctgagacccaattataccctgtactctttattcgaccaagacctcaaaagatgtcaaagaagccatttctccaaagacagcaacatctattgtgaggcactttcatattcagcagtctgtaagtttgtaggagaaaacataagtggttaatttaaaataattttgggctctaaaatggactttgttgccttttttggtgggggtggtgggaatcggattcagcccatttccaagggatagtttcttcatctcagacaactattttgtgatcctttttaaaagacattctgaaaactttaactcctgcccttcttccgtattacagttgtgttattccagaaatattgtctacttttttaatatattagattttcattcagatcttaaacatgcaaacatgtgataggttagctttttaagggagttatcagtaccactgtatctaaatgttaggtaaatgggtagatttctctttgaagttggtattttccttggcagacagcactgtatcatgctcttcaccaagctatgctctgtaatgctataatcaaggaggctactaacttgtgaacctacagtcaacacaccattgctgaaaacaaactttgattaagaacagatttgctagggggaaaaaagagtaaagtgatattttcaagcaaatataattaaaattgtttcattaaaatatatactgagtgtatattgctccacactgaaattttattttgcattaacttgttaagtaattcattttagcaatcctgcatcccattttactagtactacctctgaaatatactgtcaccttaaaaccacatcagactgtaatgtgaa

SEQ ID NO: 138108 - DNA, 1002 bp, Homo sapiens
tttcttttaggtaaggcattgtctaagatcctgaaatataaattattctttaaatccataaggataattcaccatgggaggactacaactattaatataaattggaaaacaatctatccacatactaatccaaaaatattattttttttattcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactgaacatttaaaacaaaactttaaaaaattatttaactcattatttaatgagttctctgatttagtttttaacccctatgaaaatttgacttaaactaatgactgaaaattaaatgattacaggtatgtaattgtaaattgctggtgttcttctattatctaacccaaatatttgtgtgggggtggggaagcacaatggaaaggtaatttaaccaacataacgtcaaataaattacgaagtgtacagaaacaaaatgttgtcaaaattagtcttgatggggatt

SEQ ID NO: 138109 - DNA, 1032 bp, Homo sapiens
ttttttttttttttgagacagtctcactcttgttgcccaggctgcagtgcagcagtgcgatctctgctcactgcaacctctgcccacctccaaggttcaagtgattcttctgcctcagcctcccaagtagcttggactacaggcacacaccaccatgccctactaatttttgtatttttagtagagacggggtttcaccatgttggccaggctggtctcaaacttctgacctaaggtgatccacccgcctcggcctcccaaagtgctggggttacaggtgtgagccacgcacccaacctttattcttaatcttaatctgaatgccaattaggcttgatataggaggggtctttccaagaagggagctgttttttggtttttctcttactggaacttattggattggtttttgactttataaattgttttctattagtgatttgcttaaaaggcatcctgtgactaacaggatcattttcttccatgctttgtattcctttatgttaacattttgttttctttattgtccttctaatttgatggttttttagaattttattgtgcatcaaacatgtatagtcctgggtttacataaggtaattgtatcatttggtattttctctttcagaatgaagaagtcaaattcattgaaaatgagctcgagattcaaaagcaaaaatactttaaacttcagacttttgttagaagcttgatattagcaatgaaagctgatgataaggaacaacagcaggtaggtcccaggaaagactagtaagctgcaatgtatcaagtcaaaaaatggtatgtcacacttgggttcttcatatgttttcattttaatacttcatttctgcttggcatggaggaaatatttgttatttcatgacctttgcaaacagttttcttgagaatagatgctcagattttgtgtgctccttcagtggaaaatcaaaataattgattaacatgcttttaatgtcaggttagtctttaggtgaggaaaataactttaaaattaatttcaaagaaatt

SEQ ID NO: 138110 - DNA, 1053 bp, Homo sapiens
ctcgcccttcccatcatggcctgaactaatttttcaggttaactttgaaatgcctttggccaagagggggggttcattcagatggttgagggtcttacaattttatttttggtttattaatacatacattattggtgaaagtgtaaaatggtacagctactttggaaaatattttggcagtttcttatgaaattcaacataatctttcttaacgtaagactcagcaatcctacttgaggtatttacccaagataaatgaaaacacatgtcattaaaagacttatacatcaatattcatagcaggtttatttataatagtcccaaaccagaaggcgttcaagacttcattagcaggtgaataaacaaattatggtggtgtttacacaactatgtccacctgtcaaaactcatttaactgtatacttaagaagatgaattttattgtatgaaaattatgcatcaagtaacctgattaaaaataaagtctatcccaaaggggggaaataaaacctcttccttctgtctaactgacactttgtatcctctgaccatcattcccttatttcccagcctcccacaagcccttggtaaccaccattctactctctgcttgtttgaatttgattgtttttgattgcgcacattaagtgagaacgtgatgggagtctttttgttaatggcttatttcatttagcataatgttctccaattctctccatgttttttcaaacaacaaagtatttttatatgctgaattgtatgaatggtgaatatggtaaataataataatatattgtacatttcaaaatcactatgagaaaatttgaaatgttttcaccacaaaatatggtatctgtggtggtggatatgttatgtcgtttgatttaattaatccacttggtattcataaatcataacagcattttgtaccctataaatatacacaactcttacttgtcagtttaccattaaaaagtaaaaattattctaaaaaaataatcagccagttaccatttcaaaaaacatggaagtagcctatgactattctttgca

SEQ ID NO: 138111 - DNA, 1057 bp, Homo sapiens
agagcctgtcatataattgttcaactgtaactatagttacagtagttgctgagtgagtgaacaaatgacttaatttatctttggaaataattttaaaactattatgcaagtactcatttatataaaatcaggagctggatcattgtatttttcccctacactgaattatacagtctctcattcttgagatttcatgtggcaaactgaaagaatgtttccaatggtgcatttgataattattactatgcaaccatccatactcattttggtcatagtggagtttttgactgagatacatcactagaaatccatgttcttaggaattctaaataacacaaaatgtttatgagacactttgatgggctcagtacctgaggcaagagtaactgcatcataaaatagcacctcagacttggcagtcattaatagcttgctcagagatcaaagctctggtcaatgtggaaactggagttctccttactatcatcttgacgaagaactaacaaagtttactcaaaatgtaggtagggttttaacaacaataaaaataagatagatcttgttttatgatattcagtaactgatgttatgatactagttcctctcacaagcattgatttacttagaaaatcttgaaagtatacataaattactgcctgttatctaggaagtatttaataggcttgcaaagcagctctgtgaagaaaatgtctgcaatattaaattatcttaaagctgtttatatttttcaaacattgcataaatactgaggaggagaaatatttgcatgaagaattagaagtctgcataccaaaagatgcttcatgacttttgcaaatgtgaatcaatgtttcctaatacacttgaatgcagctaagaaggactgtgcattcaaaccagatactactataatgataacgtatatctcttgtattagaaacgacttcctggtcagcactttactaatactactgctccaacaatgaatactaataaagcaaaggcctaaatttagtaaaatatattatgacaggagcatgttcaggtaaaaaaagtt

SEQ ID NO: 138112 - DNA, 1040 bp, Homo sapiens
atttaatcaaataccatttaacaaaatgctaagtaatcaaatactccattttcctggctcacataaaatgcagtatatatcagatagtagcttttctagcctcataagttggtctcagatttttaaaataggatgttcaacatatacatagaattgtctttacaacatatttttgaaatcaaatgaatgtttttaacatataatctctgtgtgactacataaaataattagaataaatttttaaaacttggtattttgctcttgacaatctaataatctagcagaaacattaaagcggattcatatgtggggtctaaattgtgtaaaataaaacagcaaaaattcctttaagaatacctaaatcatctataaaacttaactatttgcatgccttcttatgaatgtacaaccatgtacagtaatgaagacatatcatatataattgatatcttgatatgtagagtctatttaaagtatgattttacatgagactggcaagtgtgttatagttgaattcacgaaccttaagtatacatttgatgtgactccagtatacatctaaataagtgcattattttcgttgtgtatccactcttagccatgagatgcagatttccaacagtaagtacactttctttcatttacttttaaagttgcaattctccgttagctccagcagaccaggcactctgggaagcagttagccataacaggactatttccattatctccagactatttagttctcttctatcttacacataaggcctttcttcagtagtgtgccttatatttctcttcttaattcctacctccttaccctggttccaagcctgaattacttctcttccaaactattataatagtttttgtacttctttaatttactgtacacacatagacatctaagatttgtactgtataaaaatacatttctgatcataccatacgtctgtttgaatgccctcaatggctacctattttctacagaattagatataaatgcactttgccattcatgatctccacacagggacctt

SEQ ID NO: 138113 - DNA, 1017 bp, Homo sapiens
ttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaa

SEQ ID NO: 138114 - DNA, 1021 bp, Homo sapiens
taagctctgtgaggaagccactatgttttgtctatgccccgaacaactgcccggcacagagtatgctctccgtgacttagttttagaatgaatgaacttacccatgtttcgcagaggtaataagttgtttttcttactatataattaattattaaagcagctacatttgggtattaagtccttatctggacatatcacatatgcccgaaacaaaataattaaaagttctgcacccaggaaaataactcccaactggactattgataatgttctggaaggctttatctgggaccgggagggtcaaccacaggggtgaacagtttctccagaagacagctgaccgaaaccgcagcagttgccaaggcggctggaggagggcggagaaaaggcggtaactggcaggcaaggggcgtaacggggtggggctgtcctaagggaagcctagtcgaactgatttgtccctctctgctctccgtctgaaaaccttggccgaaagggttgtagacatggcggccatcagggtaagcgaaaaccaacttgcttaatttctgtgggtgccgatagcatcccggtaactgtaaaagggatcctactaacttctgaaggagccctgaaacaaggggcagggtggaggtgggttttgagataattgcaatctttatcgtttgaagcctcaagacacctgcctttccccattagggttttatcagcctgggacgctgctccctcaatcccctgtggttgtcgatttacacagtggcacagtacaaaactgggaaacggctgggtgaaaatggctggccaggcgacgagccgcagtagacgtttcggtcttcagctgcaataaagagaaaaatatatatataaacttggcatttgtctcggcgcacagggcaaggccacatgaccctatggaaggactttgttgaaacatttggggtgaaactgaccaggatagagaggtcccatagtctttcagcagtgcgctggtttacacatagtgttgttgctttctgtgctc

SEQ ID NO: 138115 - DNA, 1078 bp, Homo sapiens
aacttataatataacatatagtttattgtgtttattgcctgcctcctctctactggaatgtcatttgtatgagaacaggaatctttgttttgttcactgatatattctaagcactaagaccagagtctggcacatagtaggtgttcaattgatgtttgtggactgaatgaatatcaagaccaatcccactccattcctcagattttagtaattattacattgctatattattacataataatattccagataaatattatattgctatatttcttatgaagtagttaacaaacaggtaaaaatagtgctctgccatccagtatgagaagataattttatgaactatgtcttaaaaatgtctgaggtaatttggagtgtttgagtatttaatatattaaagtgaaaccaatagatttcctgagattcctccagtatttattaggaaatggaagatggaaagcttttcaactaaaaagatgtttttgatatatctttcttagatgggaaaactgacaaccatgcctgcaggtctgatatatgcatctgtaagtgtacatgcagccaaacaagaggaatccaaaaagcagctagtgaaaccagagcaggtaatttgcctacaaaggtttatgaactttgtataatatcaagatgacacaaaagctatattttttaaaattatctttgcccatcaaaaatgtcttagaagtctttgttaggtagatattaaaagttgagagaaatagttatgaagtatctcaaaagacaatatgtaactcaaacatctaaaattctaactccagtgaaaaacaactagtgatttttcttaatgaataatcaataagtagtggagggtgttagacgttctaggcagtctgatttttctttcttgaaaaacttacacaggtacattcagtattaggaaacttcagtttaacaaattcattaagatctcagttttggaagtgaccttagatgttttctagatcaaccttctgtatggtactgtaattccctctatagtaggcacatttagtggccatatatcttctacatgaataaaactctaggtaaaggagcc

SEQ ID NO: 138116 - DNA, 1035 bp, Homo sapiens
tttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaatggttttataagtttatttaaagtttccatattttttattaaaagacttcacttcagagttacttaggcagattggtcctttctttaatgtcttgttgaattttgttcatgaacaacaacatgaactaggaatttaaacagttacgatgactatgtaatgcatatttcttaagaatgtatgttatttgctaaaatcataatgaaatactataaataaaagtgtccattttaagatcttagatttcatattagagagaaaactaaaagttcttaacttgcttaaatgacacaatcctgagcagtgaatacatctaattatgttcccaatatacattcaaaaggaaaagtattgttgtgtgtatttggcaaagatttctgcaaatgagcataaaaataactttctatgttcaaaccagtgagcat

SEQ ID NO: 138117 - DNA, 1121 bp, Homo sapiens
ttatttgacctccattaagagaaagtaacatatttcatatttagaatcttccggtctaataatgtagtctgctgagaaatagttttataggcatagttttcactagcagagagaagtgcagagtttactacaccatcagataaatgaatgcctggtctaatatttcaacaaaattaaatgaatctcatcttaagcaggccaccttgcccaggaaaactgggccctgacaggaaagctggatcaatcaggcccaagttgtttgctaaggagactggattatatccaagatgtgaaagacagattatattcttcctcacctaatgcaagagatatggccctgttcaattcttaaaagacactaggcagtgagcaaaaaataaaacttgagctaagtggcactgctcaagcttaattggtggtgtcaaaacaattgtataaagatcatgtttttcaaatggctctaaattttaatcagatataatgtgacaataaaatgtagccattgctgtcagtgtatccttgaaagtgtattgtctcagtatgcaacttaaattatttattctgcctgatttaattatatagcctgattgacaacactaagtgcaaacagtccattctaatgccttttgactgcaatacctgcgtgcaggttcataagcgctgccagaacagtgataaatggctaaataatcttcttctgacatgtatagcagcacagtgtgaagtgttgtttagcagagaaaatagggagtgttaatgataagccaagaatatgtgctggaaaaaaatgctaacgacaggtgcaaacaattttctgtgtggaaaatcaaatatattgtaataatacgtgatggaacagcagatgtttcccagaacaagtacgacttccatcactaatatttatttttttgagtcacttttattgacccacaaaacattgctttgtttggagtttaatcaaaacagaagcaatcaaagtataacacaaaatgacattttattaaaatatattttacttctgcacatgatttgctagcagagtaaatgttaatgtcattatattcttgcttgataaggctgtgaacttttcttttatgaccaggtgctgaaaaaggtcatat

SEQ ID NO: 138118 - DNA, 1028 bp, Homo sapiens
ctcaaaatgtaacagaaattattcttagagctttgattttagctatcctaattactgcaaataaatatttgttcttatagttttaaatcaaaaagaaaagtcttgttataaaaccttaagcttgaaatcatattaataaaatatattgtacatagtggaaaattttcagtagctaatttaaaatttcagaaaatgctattaaagaattttgattcaagtatttaaactgtttagttatgcatgcttcttattaaccgaaaatgataataccatttagtttagtgatcagtatgagaagcaatacctaatcctatgttgctattgtattttttcctagttggtgtgcctgctcagaaaaacatatactgtatgtgtatacatacctgtgtatatataaaaggtcaatttatatatttttctataggaaaatggagtaacaagttccctatctcccatatttatttgtccatagtaaaatggccacattgatgataatttctagaactagtttctgagattgtcagccctttgtctaaaataatggcagtattaatgattgacttctgtcactgccatagttacctggattgtcagccttggtagcctttgtctaaagtcctaaagagttccaaaaaaaatgtgttgaaatttaattgctaaatagtggttggtgattctttacagtaggaattgtaataattttcttgcaaataagttatttactgctattgatattgaataatttgtcttttattcagatatatttcaaaaagcatgaatatatgattattcataaattgtatactttaccagtaagttttcagaggaaataaagacttttaaatccttttcagtcatggtgtcatattttgtaatacttgcatcttttatatatgccaagaatttgaagattgcctttaacctgatttatgttttaatattagtctagtatgtaaatacttaattgtcaagctgtatatttggttttgtttttaggcatctgccaactgtgctaagtttgtgagaaa

SEQ ID NO: 138119 - DNA, 1923 bp, Homo sapiens
aggactcagaaccaaaccatatcaaggctctataagaaatcatataaacaatattaaggaaattgtatttctattgatatatagaatgaatgtatttcagttctcaacaatctgaacacttgataatgaacctgatgaggtactgccatccttgaagagtggacctcaatacatgtatagaattaaagggagaagtcatagaattctgaaaacagacttacggaagttcatgtattctgattaagtactgtagcctgtttaagcaaatttttaaggataaaacacttatttttttttagttaatgccagaaatgcacacacattttaaaccgatttccaaaaacgattttatcttttcttccttggccaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatttttacgaataagtcagtagtgttttttagtatcagtagtgatatttgtttgtaaattatttacatattgggaaaggtcaataatgaagaaatgaaagaatggaaggaaaggtgtggataggctcattggtatttgaatattctgtctgtcaagtaactagagtattaggctaattgtctacagacctaatttaatcctggctgtcctactgatgatatttggtaaattgtttaacttctgagcctacgtttctccatatataaagtggaaatagtattactatgcctactatatgagaatggttatgaagacaatgcaatgccatgtttagaatcggtttgccagaagaaaattgttttagaattttcccattgacttgatgaatctcaaaagtctcacgcaggaaataattgcttgctgtcagtcaacttccaaacaaaatagatcacagtgtttttattgcattaagctttttaaatgaaaatttcttttttaaagtagtattttatagtcttacagaccagtaaaaatagtaacaagtagaattgtggttttgaaatattactaaggaaaacactctataaattgttttattccttttctggtaggtaaacctgcaaccaccaaggactccaaattgtgtatgacagttggtaagccctaatatacactacataaaaacgttagggctgcctgtaatcccagcactttgggaagctgaggtgggtagatcacttgaggtcaggagttcgagaccagcctggccaacatggcgaaaccctgtctctactaaaa

SEQ ID NO: 138120 - DNA, 1406 bp, Homo sapiens
atgctcttaaatgagagaacatgtgctcaaaatggcattcactgttatgacttcatttttgatatttgttggttgtcattaattttttaatccaataagacaaagcattaggatgtgagttaggacaacaaagttttaatcctgtatttactatttttttaataataactttattgagatatcattcatataccatatgattcacccatttgaagtgtacaattcattgtctcttagcatatttgtagaattgtccatacatcaccaccatcagttttagaacatttccatcaccccaaaagaaacgtcataccaattagtgatcacctcccatttgcccccaatttccttcagccctaggtaacctactaacccacttcctgcttatcctggatatttcatgtgtatatactattgaataactatataatttatcaagttggtttgtccatttgaaacataaggaaatcaatttatgttatcttctctatagggaaaattttaggatgaatgtgatcataaaccctttgatactagtgagaagaagtaatagaagtccaaaggagcatgactggagtaaaatctaattaacttactaatcaaaatagagtgtgtagatgcaaatttactaaatgtttacatacgaagctctgatttcctactatgtctagtcatggcttaatcggtaataggctacacagtgtagtaattgacaaacatattgtattttagaatgtaaataaaatttatttctatatttagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggtaaggctcttgatgtttctcagttttgtattaagatgttggtgtggttgggaaatattttttcctctgggaggagagaagtctagaaaagcatctctcagtagtaccatttctgtaatttgccctaaaagttttttctatgacctacaaagctactttaaatatactttaaatacaggatcaggtattttcactttcttgaataaaatgttgagttacagagattttttatgagttccatcgtgggaatgacgatagaagatgctaaaaatacatatttcataagaatttataatgccaatattttaaagaaacattgtttctaacttaaacagttggacgattgctatattattttgaaatacataaattatttttcttggtaaacagtcaagaaggttgtaactactaaggcttataaaattaattttacagtagtcttaatgcattttttaatcatagaaaataagttatagcgtagtt

SEQ ID NO: 138121 - DNA, 1034 bp, Homo sapiens
cagttatctcacatggtgcctgtgggaaatgtttccacttgtattgcatcttccacaatcttagtgatagttgtcaattggtactaatgaaacgtaatacttttaggaaagcatttaccctgtatgatctaatttgtggtcgttgttggcctgtattgagcaagttcattatttggagaagaattaaagtcacatagatgcaaagaagtattttacataattgaatttcagtagaaatgtgatagcatgttctacatgtttggttttgagtttaccttatacccttaaggtcttcagactttttgctcatttatcccttgaaccctttacaagttgacatacacagtttttcatcagaagagtcaaataattgcaaagaatataatttctaacatcgtaaatattgacttatagtaaaattataacatcagtcatttaaatgtattcagtggaatctaagtatcagggatatttgatacccatcacccatttaaaaaaataaatggaaatagaatttttttgaaactttctagggcaataagcttctaatctaaaactttcttctggatttagtaattaatgcaattattatttctacagaattaatctaactgtcataaatatattacagttttggtaaataaatattaaacagaataagtaaaatttcactgaatgaagtaggagaggtggagctgagcatctgtatgagaacccccttgtaggtgatataacttgtgaaaagtcctcttgtatcctcacacacatcccagtttgaatgctgctgacttaagtgactgactgtgccttctgcaggagattattagaatcacataatataatttagtgactaaaggcagacactctgcaggcaggccatatgggcttcaattcgagctctgagtcccagcccttccttctactaattgcatgactttaggaaatctgcatagccccccatccctgttttctcatctgtaaaatgagaataacagtttgctgttgcacaagtaaagtgaaatgatacttgtagc

SEQ ID NO: 138122 - DNA, 1052 bp, Homo sapiens
gcaccaaaaactgaaaatgctaaatatgcttattatgccataacatcccacttttggggggaaggatgtgtggaatttgacattactcataattggaaagaaatgtatattcagaacaatttgtttcaaatagaattcttggtggaaggctttttaccattctatctgaatgttgttatttatatatgtctacattagctatgtggtggaattctcatatttgtagtaattatgatgttgaaatgtttgtgatcatccatttgatcatggttttgtagaaatcaaacaataaaatcgtgtttaagaagaataaattttaaatgtaaattttatatttttaaaaaatcattaactctaaatggattttgttgtgacttattttcccttcaaacaactacttaaaataagtggacaaacacatctatacatttaaactttggttccattgtataagtgacagacatgtaatcagtattgctaaatgagtggaaccaagtgccttcccttgccctaaaacttgatgctgtaataatgaaatcatgaaataaacttattgttcttcctgttggaagaatcatttgacaaatattggcaagtactgtaactgatttagttatacttgaataaatcaaatataatcaaaatatagaccaatgagactttgtgacttgtacgcatacctcaaagtttataaaatgaattttatagaaagtaaatgatgtaaactttggtgatttaattagagttcaattgtttaacaaagaatgtgttttaaagatatattattcatgagcaaattaacttggacatacttattacaaaattatggcttttagagaaattatgggaattcttcagtaaaaatttaagcctttttgtagttttaaacactggatttcatttatgtctaatctagtttgtccattattcattagccataacaatctatatgtgaagatgtatttttctttgaaaaatattactgattttaaaggtattttccccacatagataaatccaagcagatgaggaagtttaaatttgtcacgggt

SEQ ID NO: 138123 - DNA, 1264 bp, Homo sapiens
atatgctagtatatactttcatatatgctggtatatatatactttataatatatagtatatatataatatatatattagatatatatgctatatattatatatacttatttatatattatatatacttcatatatgctgttatatatattatatattatgtaattaatatataatatattatgtaatgtattatatattatgttattatataattaatatattatatattatatgtattatataattaatatatagtatatattatatgtattatatattaatttcatgtattatatattatgtattacgtattacatattatgtattatatatagtatgtattatatactatatataatatgtaatacatattatatactatatataatacgtattatataatatattatataattatatattatataagtttgtactcttggcttccatgaaactgccctttggttcccctcatgactctggctgtttcctctctacttctttagtgggctcttgttcctttacccagtccttaaatatcagggctcctcagtatttttccctcagcccacagtatgccttgctttgggcatactcactagatgactctgtgtagtctcatgatatcaattctgcataaatcttggtgacagacacttctgtatctcccaggagtgtctggcccacatgctaagcttcctgctggacatctgtcaaatggaatacactcagaactgaactcaccatcttccctccacaaactgctcctcatccagtgttccctacttctgggaacagttctgacatcctttcaatggcaacttcttccttccctctctgacatctcttcaacttcacgtccttcaatgtacttcctaaaagttgctttgatctgccttttctcactgttcagttaggttctcatcacctctgacttgtaattggtcaccctgcctctcatcttgtctacttcaaatctgccttctacatatccttcagagtgatcagtctaaagtgtgtgtcctgattgtctttctttgttccctgtagagagttttcttctttcatcttctctctttttttttttctttttttttttttgagttgtgcagtatagatagaatgatgagacttagagggaagaataggtgtgggtccaggtaaattttatggaagtgatagtagagggttgagggaattcttttttgatggttttttatcatctctatgaggtttgagacagttaacttctcagagttcagg

SEQ ID NO: 138124 - DNA, 1040 bp, Homo sapiens
gtagttcagagtgacaagtatgagcatgggcgggtagaagaaatagtacagcagctattatattacttactccactgtcctacaattactggtttattgtctgtatctcccagtaagctatgaggtttgtgagtggatcaaagagtgccagggaggcagaagagtgaagagagcaaatagagataactcttggaggaagctaagctgtgaagagtaagagagaggaactggtctttgaagagggatgtggagatgaagagggtgtttctttactttaaaagattagtatatatttcagctgatgggatgaagccagtagagagggagaggttgaagataacgaagtaagaaggaggataattgatagatcaaggtccaggcaaaggctggggaggctaaaattcagagaacaggcaaaaatgttgcccttggatgggatgggagacacgttgaaaccagagggtgaatgcatttgtagatttgggaattcacatcttatgggttacatttattctttaaattataaacaaggtgaggtcatcttttgagaatgggggtgtgcaaatgtggatgggtagaagctcaaggaaagatgtaaaataatcaccataaggagttggagagtgtactgtctcatggtcaaattgctgggcaatattaatggcccagttgagtctgaaggtcatgaatctatagtggcattaatctgctcctatccttccagctctttcattctcttacccccacccagtctgttaagagacgtacaattcctcattccctgtttcttttcagtttatcatctgccttctgcccttttccttttccctgtgctagaccccatagtaaatcttctgaattgctctttgtctgacactctcagtacccatgttgtcatgtcctttcactacacccacagaggaagatcccattcctgagtcaggctgtaatcttcatctggatcactgatggctgcttaagaaaaccatgcaaccagacagactaaccatgccacagacacaagggtgccagcgttattc

SEQ ID NO: 138125 - DNA, 1507 bp, Homo sapiens
acatttaacagaaaaataaaaacctcgtaaaaggcctttacaggctctgaatggtatagcaaggtatttaatcaatttttctctctttcttttcttagagctgtgaaggggggaaaaaaaagcctgttttctaaacaaagggaatgcttttatgttcctaaatattaggaaatttatggtttactataattcttatcctgactttattcttattaatggcattcaaaatacatgtttaagttgtattccatgttcattttgtactttaaaagccctcaaaatagcaacaagaatatatattctgtcatttactgtcagttttgtgtcagaaaacatggaattgtaggcaagttttaaatcttgtcttcacgtgaaattcattttagattcaaaattggtagccgattacattttctcaattatttaatcattaatatgaacttttatggtatgcttatcttctttatagatgtaaagcaattatagatcagtttggtcagagaataatctctgagcatttcctcgtggaggacagttactttcctgagaacatgtgctcacgtgtgcaatacaggtaaggccccctccacccattagcaagcgaaggtaattttattgacattcctgtgtaattctgttcttcaagtaacatgcaaataaatgccaaaccaaagatatattcaatatcttacttcacttacagggtctggttttagggaagcctagcataatttcaactcctttgcttcagctggggtttgtctgtaggtcaggcattcttctttcatgagccaaggaaagattaaagccgaacttgacttggttttgggaggtgacacttttatcctgacttaaatctttgaaacgtgccttctggtggttatataactataaacgaaacttatccatggaatcagaattactgcttcactgttttgtgcattacaggcagatctccagggcagtgctgattacagatagatctgtcctaaaaacagattcagatcaacaggtaaattcagtcctatatatttttaataaaagttgtatatatgaagatgtttcggtatatatatacatggtgaactaatcactacactcaagctaattaacatatgtctttacatagttacctttttttgtggtgagaacacttaagatctactttcagcaaattttaaatatataataccatattattaactgtagtcttgtactgtacattagatctctaaaacttattctttttgtgtaactgaaagtttgtaccctttgaccaacgtctccccattttgcctagctcctggcaagcaccgttttactctctgcttctatgaatttgaagctttttgtatttcacatataagtgcaatcatgcagtactttcctttttgtgtctggcttctttcacttagcataatgtcctccaggttcatctatgttgttgcaaatggtaggactttcttcttttttaaagattgaataatattccattgtttatacatac

SEQ ID NO: 138126 - DNA, 2169 bp, Homo sapiens
ttggcacatggttgttatgctatacatttatgttgaacaaatgaactaccaatttgctagcaggtcattatcatattagacattgtaagagtctaaggcagtatcagtggagacggagagaagaggctagtttcaggaagtatttataaagcggaatcaaaatgttatagcagactagatataaaaagagatttgaggtaggaaaactgctgattatgccattgcctgacatagggattccaagggagtgggagcaggtgaggagccatgataaactcagtttgcagcatgctagttttaaaaaatgcttggctaataatactatattatttccttgagatttggtaagagcaggtattaagttcctcatgacacccacagatggtaatgatgggtggcaatagatgtgttaattcatttgtggtaatcattacacagtgtatatcaagtcattacattatacacattgactatatacaatttttgtttttcaattaagtatttattaaaagggagcttggagtctatccagaaagtagtagataatagacaattacaaatatggatacagaacttaacagaagtcagagcctaaaactatagatttgaagttatttgcctgctaatggtgtttagaactagtagagtgtttttcacccaagaaaaatgagtgggaagcatttgaaatggttttatggatgaggtagcatttgaactaatgtgtttgagaaagctcagaagggcatagtgactagggaaaattattttgttttcttcagtgattgagaatcttctaatttccttagtacattttcctttaaattattccatatgtgatttctgctttctttatcataaaattagttggtatattcattctgaagatcacagagattgaatacttgttttagtgttatttttcctcttctgggccaaattccagattttgagttttcatcttactattttcttcctcatcatcattttgctatctacacacttatatcgttgaaccaataactgaataacttgtgatttgttgatttagaaagcttagctctagaaatgttctgtctggcttgagtgttttgtatggtcagcttggtcattgtgtccctgtaactggagacacctgttacgttcctcctcaagttactatttatgaggctcagcaaggccctcaactaaatcttacgtggtttaatctttcctgccttcctcaggtttatgtgggaggggtattttcatgactctggcagcactgtttattttgctgctttctgttaattaaatgtcatctaattttttatatgaatctttataatacaaagactaaatttagatctaaaatcaatgtttttttattcattgttttcccaattatgctgaatatatgacagtaagttaaatgtctgagaggaaaacatatcttatcacttgcttaaacatgtcttgatttgagcagttttgcttaagcctagagtcttagtacttcagcgtgatattatcaggtgagtcatgttattatcatctaccagactgagacttgggcatatgtgaccatcacctcaatttctgcagaaacaaatattttatctgtaccaatagcccttgatttttctccacctagcacaacataagagatacaacagtagcagtggcacgcttgacagtgatttttttcctgggatttgggagcttatcagaatctccaggggtactttataatttcaaaaagtcccccaggtgtgattctgatttgcttccttttcctcctcctgctctgagaatcaccgtttctttagaagcatcagcataaataggcacatgtattagtatcttctcctggtatggttgagctccctaactcccaaacccccatacttgccttttgagtgatctccattagttctttctaatatcataacttttgaaacaaatgtctgtcaccaaaggtatggctaccaccaaaacaacctcgttcatgtttagaagcctacaaagcttgagggccaggtttaataatacagtttaaatgggaaccctttttaaagacttacactcaggtctgagatttatattaacactgaccccctcccccagttttattttaacattttatgatgaacattttcaaacttatactgacatggaaggaatttcaagaga

SEQ ID NO: 138127 - DNA, 1343 bp, Homo sapiens
gcttatttggtgtttatttgcttagattcttttacccttggggtcccatttcagtcccatgtgacatgaataatttgcatagctcatgtttgtttgtttgtttgttttttaaaggtatgctagtatagtaattgcctttgttgaactaaaggctaccttttccttacctttgacttagtttttatgacatgctctaaacagaggagctcttttttatgatctggtacagattccagttgcaacagatagctgaaagctaatggtctagagaccaaatgaatctctagattggtggttttcaaactttaatgtgcccaaaaattaccaggtaatcttggcaaaaatgcagatttctgttcttcaccctcagaaagtgaaattggttaatatgcttagggggaatgcagtaatttgcagttttaaagaaaaccccaagtgaatctagtataggaagtccttagattagataacactgatctgtaaggtaaaattgagggtttagtaaagggtactgtgttccatcacaaactgggggctctaggtcttaattcagtctaaggccgtatcaatatgaaactgccagatataccaacaatcaaatgtgaattttaaatagcagacagactgcttctaagaatatcttcatagaaagacatgtcttgttttgtaacttctaaggcatgagtaaaggttgtgtagcccttgaatgagaggagacttggatttccactagtgccatgaatgacagtgggcaaatcctttcctctggaccggatcctttatctgtaagatgaatgacatggactctgcagtaatctctggatatctttctagatttgacatgccttggttgagttcttagatagttctttggtaatgttcttagaaagtacttggcttttccttatttagaaataaattatcttaaagtattttatatgctcaaatgtaagccattctcacataatgcatcatcttcagtcccagtgagaaatttaaagaagttgaacaacttggatgtgcctgcttttatgaatataaattaaatagcacacagtcttcttgtgctattaattatattgttatattactagaaccccagttttccagtgaacatcatcttcttgtccatcttgttttttcagaatgcaatgattttggattctgtatatgaatctcttcctggaaaatttattctaagctataattatttatttctgtaacttgccagtttttaaaacttgacctgtaatcatagtactactgtcatctacaatattctcactatactaaattgcttaagtgatctttaaaagttttaagactcaagcaatacttgaaaa

SEQ ID NO: 138128 - DNA, 1033 bp, Homo sapiens
gtaaatactgcatttatagttcatgcacatgtgtgtaaagacttttgggatccccttcccgtgtgtgtgtgtatataaaaataaatacatgcatttagatttccctacatgtattttttcagactggcagccaccaatcaggtcaacattacaacatgacagaaaactcaatatgttgttttaaatatagtgttatgataaatgcatatgtatgaatatagttacaagaaacaaagttgaactttttgtagatagatgcaatcactgaagtcttacagtgtctcgtgacatgtaggcatgcctacttactgttggaatggaacttctgcttttcagtttacggttttagctggggtgtcactaaagcacattgatgatcaatggtcactctaatttttctcttgtaacagacctttttgtttggtttgtttttaatggaatttgatgaagagttcaaatgtatttttgtagtgacttttttggggacagtcctacctactgtgtttagtagatttcttttttagataagtcctgcaaaatttatacttgcttgcctctaggctgcatactaccctttggaagggaggtgtacagagctgtcttgccaggtgttatgttaggccttaggatggcttctgtaaactgcaccaaagatggagcctacctgacatctcagagatgtttgccatctttggttgcttaattgtccttcactaagacgtgttaacctttgggttgttaggctgccatttaatgcactggaagaaaacgtgtcatgtggaaacttattacctcccccaaaatcatggtaaagtatttaccttctactcacagctttttctttatttaaaaatttctagcttaccagtatactttatacatcacattttaaaatatggattacaagatagtcataatttgctaggtactctgaagaccactattcccatggttatactttgagtttttgcactatctaaaatgaagtcacacataatccatttaacatgtacagacagaataaacatgtact

SEQ ID NO: 138129 - DNA, 1652 bp, Homo sapiens
aatacaaatctgatcatgtcactgccttgctcaaaacttgctggttgtactactcattgtacttaagagtaaagtttaagatctttaacctggccttgaaagccttgcatgattaggcccccaactatatgcgtcctcgtttcctactgtattcctccctattcactgtgatccatctcccttagccatctctcttcttcttcaaatacactgagctagcttgcacttcaagttttgaaatttcattttctttctgcttggaatgttcttccaccctttcatgtggtcagtttcttctgatcattcaggtctcagctcagataccagttcctcaaagagactgtccctgaataccctgtctaatgttccaacccccatatcaccttcaccttatcctgttttattatcttcagaacacttaccactatctactcttatttcttgtttgttgtctctctcttgtactaggtaagttatatgacagcagggacagcatttgtctcgcatacttttgtatccccagtgcccagaattatacctggtacatagtagacctagttctacaaatatttgtgcataaaagtataaatgttgttgcttgttgccatcagcattaacacttctcttaaaactgtcacaagttcctctgtagaaggtagttgaattgaccaggtccccaagttgcttgaattctgttagaaactacagggcttgaacacctggaggtggactctcacacagtcaataagagcaatgtagcctacaaaccccacattggtggtacaatctgtaattattatctcctttgctacggaagatgatagctaacaaaagcgttgatgtatttaacatttaccatgcaccaggcagatagtaagcactttacatgtattaacccatttaatccttgtggcaagtctatgcaatagatatcattatccccattttatagtcttgagaactgaagcactgtcacacagctggtaagtgggaggaatcgggaaaggaacctaggcagtctgactcaagagttagaatgtccacattaatttcacaatcacccccacgagttgatctctttgcaatttgcacatcattactaaagttatacacttgacttctagtgacctagtaattttgattttggtgatcactgcttgctaaacaagcccactcaacttctgtcatcatgactcatatcaggtcacgcttgctgttttggcaatactggatcattgtgaatgaggctatgttgtagtggaacactcatttgaaggcttttttgatggccttgctgaatagagtaaaaccttatagataatgagtttcaagagcttgtagcagaggatgaggcctggcttgggattgttttgaacgtaactgtttcctgaggctgcaggagtcattgcctatgaaagatcatccccaacttggtttgatttaaggttttcttgacattaaaatggtatgaaagtgatacacattcagtacactcctcaacttatgatggagttgtgtcccattatacccattgatattttcagtttacaaggcaaggagcatctgtatttagctactgctcttgaggaagcattctgtttcaggccaataggaagtccatgctgagttggattccaatagcttgagtctta

SEQ ID NO: 138130 - DNA, 1066 bp, Homo sapiens
gtctctttacctttatgttatttgtacaatttgaattttcaagactgggcagcaaaatggaacaatgatttaaataaggattactcaaaacaaaaatgaatatatatcatacaggacattaaaccagagaaagagcccaagaaaggagattgagcaaaagaaatcttatagagattctaagtaggattgctgtaggctagtttgctacaccccaaaagtttgaaccaaaggctttcttttgaatttaaaaaacctatttttgaatgaatttgcttaggtatctctgtggcagataataaagatggggcaaatagcatgggtgttcagactgaaaaatgcaattttattaagagcttagtttaaattatgatgtgtttaaagagtagtcaggaaacaccagtgcttttccatcaaaagttccattgaaatgatgtccattgacatcattgtgataagctatattgaggaatcattgagttggttcggtggttctggcccttgtacaaaccaggtggtcactgtacttatgaaacatagatatggaggctagggtttgacccaaacatataagttgaccctcagtattttagaaggctttatgttttaaagattgagtgatcacttgtagtctataatttgtgctaatttattctggacccctggtacaattactaatacagatctgtttttgtcatccaatacatagttttactgtgactgtcctatagaaggttaaatttaaggacagctggaaaaactgaaagatattgaatgtatcatctacagtctcatcaagaatagaggaagctagataaatggctaagatttataaaaaggaggcactttttgggagcaagttttctgaaggctatgtgttgttttttttgacagctttttctagattaagcatgatgattatgccttccaagattgacagcagttcctaaagggcagtccatctgcccacaaccttttccttgagtgggaaatccacaccagaagccccactagactcagatacttgtactacataatttcttgaattagcagcagtgctgttattcca

SEQ ID NO: 138131 - DNA, 1632 bp, Homo sapiens
tgagtgtcagaggatcttttgatatgcggaaaggttgagtgagggagttaatcaggagtgtgtttgtgacaataccaatggaggccattggtgagcatacacatcattgctgcttgcttttttgatgtatcactgtgcttccctaatttcttacgttcaagctttctgtcttttggtatatgattttctgagtttgagactttttacttcttttggaaaatatgcatcatatttaatttgctttattgcttttatatagttgtatgactcaacagctttgatgatagaaccttagctgaagggctggggaactttaaaaaacataataaaatgaagcattaaattcaggacacagaatgttctgtgtgtaaaaatagattaaataataataatatatcaatgtcccttgacattttttctctgatctccctccagcctgtcatggccttgtgcccagtgtttatcttaaggggcagaaatggcctcttgtcacctttaggaaaaactccggttaaggcaaagacctactgttcatttttcatatatagaatcccacatgcataattttagaaatgaaaacattgccttacatattgcacttatgaatttggaagctattttcaaagattcttttatgttttcagtttctaaagcattaatacagttcagttattataattttttattttatttatttatttttttgaaacggagtcttgctctgtagccaggctgtagtgcagtggcgcgatctcggctcactgcaacctctgcctcttgggttcaagagattctcctgcctcagcctctcgagtagctgggactgcaggcgcccgccaccatgcccagctaatttttgtatttttagtagagatggggtttcaccatgttggccaggatggtctcaaactcctgacctcagattatctgcctgcctcggcctcccaaagtgctgggactacaggcctgagccaccgcgcccggccctatttttataatttaaaattagtacgaatgcatatgtatataatagttcttatgttttgacaataaagatactgaataaagagacactttcattgtgtccacacagtatatttctctcttaacaggttccctaaccctgaagcctgtcttctttcttgttatacagattagtttttaattaaagaaaactagttggatgcagttactttctgtgaaatgaagatttattttggaagtgaccttcactttattagctgaagcagtaatcagaagaattaatagaataatcaaattatatacaaactcataaatcatcttgaatagtgctgtcaaaagttcggctattagtgggtcatactgttttgcagctatgattaagaaaattacaactgctgatttgtaccttgataggaaccaaaattgcttttgtaaagcatatgtagaaggggggctaccagccaaaaattttgacaactcttagtttatctgtagtgcaatttgatgtcaccagggcaaagttgaaattcagtacatgttggtatgctctctttcagtaaaatctgactcgttggatataatatactcaattagagttatattgatttaaatgtctgttgtttggggttaataacatcaaagaattag

SEQ ID NO: 138132 - DNA, 2928 bp, Homo sapiens
ttatctcctccaaatctcatgttgaaatttgatcccccagtgttggagttgggacctagtgggaagtgttagggacatgggggtggattccttatgaatggcttggtgcgatccttgaggtcgtaagtgagttctcactctatttcacatggaaagtgttaaagaacctggcctcctctcctccctcccttgcttcgtcctcttttactgtgtgacacatctactccctctttgccttccaccattattggaaacttcctgaagctctcaccagaagcagatgctggcaccatgtttcttgaacagcctgtggaactgggagccaaataaactgctttataaattactcagcctgaggtattcctttatatcagtgcaaacagactaagacagttttatttggtaaaacttctctgattttaatctcaccaaattagaatttataacaaaacattcataacaattttaatgtttttacctcctactctgtatgtaaacagtttgatgatcaaatgaataccatgaacaagaaggtatattaccttcttattatacctactcaagaaaccaaacattactgggtatatacccaaaggattataaatcatgctgctataaagacacatggacacatatgtttattgtggcactattcacaatagcaaaacttggaaccaacccaaatgtccatcagtgatagactggattaaggaaatgtggcacatatacaccgtggaatactatgcagccataaaaaaggatgagttcatgtcctttgtagggacatcagtgaagctggaaaccatcattctgagcaaactatcgcaaggacagaaaaccaaacaccacatgttctcactcataggtgggaattgagcaatgagaacacttggacacaggatggacacaggatggggaacatcacaccaggacctgtcatggggtggggggaggggggagggataacattaggagaaatacctaatgtaaacgatgtgttgatggatgcagcacaccaccatggcacatgtatacatatgtaacaaacctgcacattgtgcacatgtgccctaaaaaaaaaaaaaaaaaaaaaaaaaaggctgagcgcagtggctcatgcctgtaattccagcactttgggaggccaaggtgggcagatcacaaggtcaggagatcgagaccatcctgcgtaacacagtgaaaccctgtctctactaaaaatacaaaaaattaaactggtgtagtggcaggcctttgtagtcccagctactcaggaggctgaggcaggagaatggcgtgaacccaggaggcggaggttgcagtgagccgagattgcgctactgcactccagcctgggcaacagagcgagactccgtctcaaagaaaaaaaaaaaaaaagctaatttcaaccattttgtaaatgactcctgcaatcttgaattcatgtactgagtgacaacacttgaatttaataaacctatattttataatatgcatccttcatttatttcatagaaattaaattttgccatgcagatacacacgtgtttgtaaacagccatccctattaaatgttttgcttttccatctgcagtttttaaaagaaaaatgattctgtgtggctgtttttcttaagtaaatctcttttcactctattagaatgtaaaatattccttctcgatccccacagtctttaattgtggtcctatctgcatagaatcttattcttcaggtgtatttaaaggagaaattaactctaaaataacccttttaaatagcacacatttattgaacaaataattagctttgatcctaactttgtgttttaacttcttgtattataaaagtctgcaaagtgtatataggcatagtgtggtggtcaagagcacagactttgaagccagactttctgagttagaatcctactgtttaacctctctgttttacaatttcttcctttataaaaaaggaatagtacctatatcatggggttattatgaggattaggaaattgatatttgcaaagctcttagaataatatctggcacatgatcagcactatatgagccattgttagttaaaataatttccaaactgtgttaagttgtgaatatatgaattcagattttttttcttatttatttattttattttattttttgagacagagtctcactaaatcccatgctggagtgcaatggctcttcagaggtgcgatcttggtgcactgcagcctcaaactcctgagctcaagggatcctcctgccttagcctcccaagtaactgggactacaagcacaccactgtgcctggctttgagtttaggttcttaggtatagtaggctggtctcaaatgcctaacaaattgagagacagacttctgattggagtgtttctaccttccatgatgttttcataatcaacacttaactgccaggctgtagtgatcctataacaagtgtaaatgtaccaagagcagagctgctactgtcacatatcttgtgtagcacctgcttgtccctcactgaattaactttcttgcttgtctttttttgtgaggttaggcctcactctttccatgcattgtggtggggcagtagtgtatgctatgatgtacttctttcctagaatatacagacgaaaacaagcattagttttctttgtgctccaaaaggagaaataaaaagtgctgtttaatgtccaattaggacatgaaagttttaatgtttgaaatgggctctttaaggtctgcaaactaaggcaatcactgtattgtacagataaatcaagtgcgactcagaagtgttttgtcatatgtttttatatgttcagtattctagccacgatgagactgcactactcatgtccagtgcagtttctgttttataatagagatttaataatatcacaatttatatgagaaaagaa

SEQ ID NO: 138133 - DNA, 1273 bp, Homo sapiens
aaataacataagtattattttttgttacaagaattaactgaaatcccatcacctgttaacaatagcacactgaatattttggtgtattttcttctacattttttagtccacacatttaaaaaagtatatagctttgtgcatcacttaacaacagggatacattctgagaaatgcatcattaggtgattccatagttgtgcaaacatcataaagtgttcttacacaaacctagatgatacaacctactatatgcctagactgtatgatatagcctattgcttcttggctacaaacctgtacagcgtgtgactgcactgaatactgtaggcaattgtgtaacataatgataagtatttgtgtatctaaacatacgtaagcataggaaaggtacagtaaaaatacagtattagaatcttatgggactttcctcatatatgtggtccattattctctgaaatattgttatgtggcgcatggttataatctcaatattttttgtatttgggcatcttcaactatagaataagcagacttacagccatcattaaaaacacacacacacacacatatatcagcttaaaatagcaacggaaggctggctagattaagaggaggtctttaaattcaggaggccttaaactgatatgcaatgtttgtaatcagttacttgggtttcaggaatttagggggtaaataccctgaaattgcatgccaaatattgtgcgtataatgtgcatagctacatttttctaggaaggaagttcatagtgtctctattagtgtctcagaggagtgtgtgactgccccctgcaaccccaccaccaaaaaaaaaaaaaaaagattaggaaccactgagatatactatctcaattgagaactgtctttactaaattagaagagtagtgtgcagtagattgacaaaaagcttctatcccaaaagtttgaaggttgctgtttgaatagaattcttataaactatggaattttggaggataaaataagcacagcaacatactttattttcagaataatttgtatatgattttaaagacaatttcctctctagttgatagtttatattagcatggagatgatacatgattatgtttgtatgatcaattatttgtttttcccttgaggaaagagtgtttcttgggataaacagaagggggtggtgagataatccatcattttgaaacctgttctctggtgatggatggatatattggtaaagtaactcaataatcttcatttttttccaggttattcacag

SEQ ID NO: 138134 - DNA, 1037 bp, Homo sapiens
gtcatagagccacgtgatatagctaaatctaggtgcagaaactgaccctgcgtcaaatgggtagatttgactagtccagatgtgtgtgtgtgaagctcgattattgaatcacaacatactatccttttgcagcactgcagctgaggagaactgcattgagatatgcgaaatgttcttgatctagcatccataagaccttgaaatttatttacaaaatgttttatgtttcttcataaaagaagtccatagtttcatcacatttcacaggcatccatgacttaaaaacaaggattgagaaccgttgttaggaatttttattatttttttaaactcagataaacattccttaagaccttataaaaggaagaggtcctaaagagtgaatacaagagtgcttctgggatttaaagacttggggttgggggttgggggttgggggctaagggaaggggaaaagttggaaaatgttgccgttagtactatgatatataggcacctcttcatataacatgcaagcagatgatatctatgccttagtcatatgggacagaaatattataagtgtagaatagtgaataagaaagtatattttggagccagaccaatgggatcatctcctgattctgctatttattaactgtgtatcattgggcaaattatttaacttctctgtgctcatcatttttggtgggataatagtacatacctcataggttgtgaggattaaaatgagctaacatgtagaagaaagtgcttttaatattgcttgcccaagtactagataagtgttagctgttattactattactgttgttactgtgattgtttttaaccattgctgctgctgctgctgctgttacagaatgccagcagggaaaatatgaggcagttagagacttagctagatttagtaatctaagttaggaatcagcgattttttttttcgtaaatagacaaatattatagtacatagtttaggtattgcaggccgcgtggtctccattgaaaccttttgtagccatagacaatatgttaac

SEQ ID NO: 138135 - DNA, 1035 bp, Homo sapiens
tatatagactgtaaggtattttatattgttttttcttttccccctgcttttaaaaatccccttcttcattgcagagtcaatacattttacggagtgttttttagttctctttggataaatcataagataaagcatctcttagaccaaaggaactaccttattttattctatgataaccattgtgtttttctacagagagttttcagaaatctaagaaacatttcctatcctggatcaacctattagaaaaccaagagaagtcttaaaattggccaaggagtatactgttggaaaatttaaagagtttatatattcaactgcatgtgaagtcagagcaacattgagatggaattttagtgtctgcccccgatgttgttgctcctctaccttaacaagttggagttagattatagatgtagattcttcaacagtacattattttttttttcttccatagtattctccttaacctcttttcttgtaaaaatctacctactattctggtagcagtacaaaaaaaattaaagttgatagaactcttttatattgttttgactggttgtctaatttttacaaatgaacaaagttaagataaaaaggctgaggctagaaaccagattttctaatatgcatttttcttgactcacctattatatttttaaacaacttttttgaaaataattaagacataatttgcaaaaatattgtgttattttctggaacttgttatatttgtggtatttcttaatttttaacaacttgtaatttgctatgacttaattattttctcattatggatgcatattcagcttccagaaaaagttggagagaatacggggcattcttacagtattctagaaacatgttccaattctgtgcccaatacaaaatgccagtttagataaataaagaatttatttcaactttctatattttaattaattgataaaggtaaaaggaaaaacaagccatgagcaaattatctcctccttacccctataacttgaatttgtgcattcgataagcattaatgct

SEQ ID NO: 138136 - DNA, 1394 bp, Homo sapiens
cactcctgtggagcttagggtaaggaacagaaacagaatgaacagatcactgggaagtgatctaaagctcactggcctccttactagtgttttacaaaaatggaatgtttagccctatttctcttttttccactaaatccctctatttctaattcatacattaaaaaatgcattttgtttttatttcttttgaagggaaaagacatttacaagttttgtttgtcatgtacagatataaaatttcagaatgtgatcttatgtattgaatcttagacaaagaaaacatttttctccaaagatggttgtaaccttaaggctgagatttgtcagccttacatatatttttattatctgcagagcctacatgtggctcagattgaatgttttttataaaaattatacctcatcctgccgggtgcggtggctcatgcctgtaatcccagcactttggggttaaatatattaaacttctgggtaattctcttgagttcttacattttatatacaagagtctgtctgtgaattataataaacatgcatttccttgacctacagatattaacttttagttttatattagattctcttcataatgctttataattccatataaatattgttttatttttatcctaaagtagtaacactattaccatctatacatcatagcctacactttttatcaccaggttatcagaataaggtatcacctgttctgtgatttctaaccaccattctatattctgttttaatataagcctcttaagcatttctcacagccagttacagcatgttctcatcaaggctactattataaatggtatgcatgcatatttatgtgaaggattcaaagacacttggaagtcatatccttgcattctaaatgatttctgcatgtgacattttaactactagagataactttcatgaataaatgtcctttgaggcttttatcaatttaaataggtagatttttttttggtaaagaaaatgaaacatatttatgttgctacctagtatccattaatatgtcaagatacaataattggagcatattggaagaaaagtcattaaaacctatatatttttctagtctagcaagctttacagttttccctaatgtaaattaattggttgatacattttctggcacattgcacaggatatatatgcagtttatagactttaaaacgctcacaatatattttccaaacagaagtcctttttaagccttaactgacctatttgtttatttgtgtggttggtaacatagtagcctttataactacattctagtttggaataagttttatatactacgtcaggtatttataacctgttaattggagcagtatcagtgggaacaaacttcacattttttttttatgtgtaga

SEQ ID NO: 138137 - DNA, 1053 bp, Homo sapiens
aggtgttaatttctttgtctttatcttgcttagtataggttgaaccatatgaaattaacattattcaaccattttagacctacattatcctatggttcaactaaatacattgtgctttttctgtctgtaaatttatgtttattgttttggaaatttatcagccaatatctttataagtattgttttttcttccttttctcttctcgcctttttggaaccctaagtaggtaagttttagaacttagcattctctcttctgtatctctcaatatctttttcatatttgctatcttcttgtctttctggctgcattctgggtacctaattaagatctgtattccagcatattgattctcttcacctgtaacccattcattttctttcttcaatattatctttcatttttagaaattctactcaccatcttctctgtcattcttgattttttttacttgttcatttttgaaattatttattcatttcatatatagatattttacattctctttctgataactctaatatttaaacttcataacgatataatattgccgtgtattgtttctactgattcatctcagtgatttgtgtgtgtgtgtgtgtgtgtgcaatgcttttccttagctgagagtttatatttgattgattttaatctggggacccaaattgggagtgcctttcttcagggattatttgtgtttgcttcatcctcacggcactacagaattaggatcattttagttccctttgggggtcgtcacttaataatgcaatacaacctccacatagtgataccattacaagatatatatatatatatatatatatatatatatttaatttcagtgtttattgctcaaagcttttatttcaggttagggtttgtattgtatgtacatggggatcagtgtttcccatggacattccccttccttcagtgtcattggttcaataacaattatttcatccaagacctagttttggtattaactggaagtgtcttcacagtatctagttcagtttactactggaagtaggtattctcaaatttac

SEQ ID NO: 138138 - DNA, 1874 bp, Homo sapiens
tattttagaaagtaatgaagtacatatactgatatgttatatgttaggttaaattattagcagggtctgaggaggaactctaactaaacacattatttctgcagtgaaatatatgaatatttatgttaatttggacaaacaaagccagagtgccttatcagtatggatcaggttttgctgctaaacatgttttgtaaaaacttatggattgcaaagttttttgaattttgaatttcagctaatcaattctgagcctgtaatagattgtgttatgtattataatatttataggtatgattgtttctacaaataataaaaaatatagcaaaattatgtatctttattgttttccaatttttctactatttcaacttttatcttgtaaaatattttctttgtacagctgctgtattctcgaggattactaattgatcttctaatcaaatctaatgttagtcgatatgcagagtttaaaaatattaccaggattcttgcatttcgagaaggacgagtggaacaggtactgtgctgatcaagaattgtaactgggcatcagcttaagttattatggtttgttttggaaagataagcaaataagattgttattttcctcataaagcagtaaattccagtcctccgtggtgatttacaaatgtaaatgcttaattaaaatttctagtgctaattttctcatggcttactctgcagcttggtgttggtaccaagcagcacacaaaaaaccaaaaagcacaccagagttactatacccaagactagtcacacaaatccttttctcccattaatcaagattttggagagggaaaagaaagaaacggtgatttttgctgtccacttgatcagattccacacagaggaggaggcccggagcctggttgggaaaaaattcttacccttatgacagctgatcagatcctgggttcttcactgcagcttccagaagagcagagctttgctatcctgctcacagcaccaaaactgtaggggccaagggaaacactccctcttaagcctctgaagtttcactgaaaaatcaactcacaaaggcagattaattggagaaaaggcataaaaatgtactaacatgtacatagggagaaccacagtgtttgttttagatagcactgctaaatttttctctgttaggatgacatgccgttggccttttaatggcatggggagtaacttggcagaattaagtaagaaagctcacaattagctctgaagttagcagagatgccattagtactgatggacggtgatgtgaaaaagcctggctagagtggaaacgataatcctgttatatgtaaaggggaaaaaagtgtaatttggaatagttatatcattaggaagcagtttcttaacttaaaatcataatatttttcaggttccgtgttccagagcagatgtctttaatagcaaacaacttactatggtagaaaagcgaatgctaatgaaatttcttacattttgtatggaatatgagaaatatcctgatgaatataaaggtatttttttcattaagtagtgctctccaattatttgacatttcttactattttaatatgcttgctctgatttagtgagccacttattactgttttaaaatgcattctaactctgcactatcaataggttagccattagtaacatttagctatttaaatttaaattaattaaagtgaaataaaataaaataaattcagtttctcagtcttattagctgtatttcaagggctcccatagccccatgtggctacagtgcagatattttcattgctgaagtggcatgctagattttaatttttattcttattatttaaatactactgtcaactggctcttcatagatgata

SEQ ID NO: 138139 - DNA, 1886 bp, Homo sapiens
gatcatatgatagatttatttttaattttttgaggaacttctgtactgttttccataatggctgtactgatttgcattcctaccaacagtgtgtgagagttcttctttcttaccatgtaatagtttcatagtttatgtggggaaataaaagtagctattgtttctagttttagatcttgaacagactataaaaaggtgcaatatattaattcacacttaaatcacacaaactcaagttattcttaggtaaaatatcgttgcttgttaattgcataaagtcatctagtttctttagtgagaagagattttatctttctaaaatattaacaatagctttatacattttctgtcctattttctgcattgtactgaacgttgtttccctttttctggtataatattaaagcaggatgaaaacttatttgttaccttcaaatgaaccaactctaatgtattcataccaaaataaagatttttttgcaataggaatctaaaattctactgatttattttgaattcttaaatttccacttaaaaattatacaagcaacaggagcttctcgaacactaatacttctaatttagatgaagcgaatacaaataaaatgtaaaatcacctgtaatttttacagtttagaggaaattactcatcactgtctacagttaagtgtgttttaggccagaattgaaacactgcccaactaaatgtggtttaaacaagtccataggtaagtgggtgggtgggtaggtagaggatttgtaattgtgctgcttcagcccatcagagccctggggcagcactccacacttctcttagccttccatttggagttacaagatgtttgccaggatttcaaagaggttctcacataagaaaaaaacttctaaacatgaggaaaaggggaagaggttttcttaacatgtttatgcttttttattttactggaaagtcttcaacaagggcccccagcagactcatcattatcttattggctgaaactggataatgtactcacttctaaatcaaacaccagcaaagggaggtaaaattatcataattggttttgatctgtcatgatccatccccaaggactgagcagcttctctctaatattggaacaaaattggagctcttaaagcaaagagaaaaagggtatttgttgttgagtagacaaccaacagtcctgctgcacaccattttatgaagttttgttcttgggtaaacatgacaagaggttgacatttcacctgtattctatagtatgtgttaacgttttaggttggtaacaaactgggaaatatatatctaccaatgtatcatattgcagcaattcaaaattgatttcactttttatattgctattttgtagaacaacaatttctgaatagtctgatttttgtaattcttatgaatagccattaaacatttattttaggaataaacagctgggtagcagtataatatatactgtgaaaatcagaaataaatggccttagaacaaagtataaacatcaaagtaaaagaatacaatgtctgcagcaagtcgtattgggtaagagaaggtgcaaatggctgaaaaataaatggtgaacacctgtgctgaataaattaaacacctgttcctcagtttttcatttgattcctctaaaaggctgttacaaggtattcataagacacatttactttgaggtgtttctttgttattactattaattgggaagcagtactagatgatatcagaatatatacctccaaactctcagagtagtatatgaattttggcaattagtgaaaaatgcatttacaaaaagcagtgttaagcagtttttattaagaaaaattatctaaaaaatattgttacattataaatgacctttggaattaa

SEQ ID NO: 138140 - DNA, 1044 bp, Homo sapiens
aatcaaaatttgatatgactagcgaccaaccttcaaagatctgaaaataaatagaacgaagttattttgactctgctgttttgaccaaaaaatgttaaaaaaaaggccctgtttttattaataagtaatgtatataacagatatacttgattctcagcagatagagggttagttgtcctagttcttaagcaatgtccaaacagccatgtccgaatgactttttcaaaatttcatataccctgacagaaatctgtaaatcagatctagtttttgatagtacagattttacacattgtttttctccccttcctttgaagttgaaacacttgttggactttctttggtgactctgaggtgatatcctttgagttttggtaagatgaaataagcatgaatttagacaagaggtaaattttctcagaaaattgcatgtttcacactgcccactttgattaaaacttcttatctgtgttttgtttaggaaaacagtgacattgtaagtgacagtccagtgtggcaagaccagatccttgaaaatgaagaagccattgctcttagcaggaaggacaaaactattcaacatgtggaagtattttgttatgccaggtatgaaaagtatttactgcaggtaaactaaattaatgactttttcactcttctttagaagaagccaacaataaagatttatgtggcattggttgctacaagtcacgttaatatgctggttttgcctgtttttaaatggaactttcagttgtctctgtttaggtaataatgataacattttaccttaacgcctccgaatttaccaagccgttttaaatatattatctcatttgatcattaaaacaattctttgctagggtagggcagatagtagtattaatagttggattttttttacagaatcctcaatggaacttaaggagattaagtagttgcagaaggtcacgtggcttggtaaacggcagggccacacttaagctccagagtggtagagctcaagattaaattccagagtttttcctagtgctccagtgttct

SEQ ID NO: 138141 - DNA, 1051 bp, Homo sapiens
tgcttagtgtgtagtttaaacccttgccaaaagactggtgctgtttttttttccactaagtaaaaacacgagaggatcaggatgtttcatcatggtgaaggagttcgtagtagcactatagaattgcactaaacttttaaagcatgctttatttttataactaatataaaaaatactagcttctatcaacatggtagatcatatgacaaaaatttttgaagagtctggaacttacagggtattaactatcaaatagaaaacttgaatttttaaaatcataaaacatcattatctttggcaatttttaatttttggttggtgctggtagaaataatatatatatgtctttttatgataatcagctttatggtatgattaagtttgattctaaagcataaatgttttgtttttatactgctatattggtcaaaagcaaaataatgtatcttgtaagcagcccctttctaaactagctgacatatttcttaagctaaaaagtgtgtgccattccccctcagaggcattgtggcttcggagttatatctgggtttaaatttcaactctagaacttttttttgtttgttctaagcattgggcagaaagttaagatattcatgtcctggttctttttcttcttctctaaaatgcatatgcatatggttatctctcagtgcaattgggagactcagatgagctagtgtgtgaacatggtttttaactgaacaatatatagtagttacagttgctcattgatggtaatttacatacaaaaagattgtaagtacttttaaaaattattttttcttgccaaattaagcagaactgctttttaaaaaatatatctggccgggcacagtggctcacgcctataatctcagcactttgggaggccgaggtgggcggatcacaaggtcaggacattgagaccatcctggccaacatggtgaaaccctgtctctactaaaaatacaaaaattagctgggtgtgcggcgcatgcctgtaatcccagctactcgggaggctgaggcaggagaatcatttgaaccaggg

SEQ ID NO: 138142 - DNA, 1095 bp, Homo sapiens
actttgccaggaatgctcctttccactttcctttttccgtcttctgcactcctcagttagggttgttagagaccctgaaagacccagctaatttctcctgttctttggagctttccatgactccctctacagagggagtgtttctttccattgtgtttctatcacagttttaaatacacttattattttaatctctttaaattcttgttacatagactctgagctctaacaggctagggattatcttgcaaaaaacgtatggcaacctctcactacctagcacagtttgttctctctctcccttcctctcccctttccccattttctttttcttttcttcagcaaatatctatggagaacctactacatgcctcctgtatcctggaaattctgtttattgaatgggtgggaagaaatatgaaatcttggccaagaagacattgttaactgtattattagtttgctattttagtcattctaagcatgaagataataggcccttgccatttaacattagaacagcttatgaatttcacaaacttatgggaatgtttggatggaagtattaaggaaaaacacaaatgatagtcattttggctttatgtaatttggactcaaatcatgttcagtattgaaatccattcttggctttgctttaatagcagagatttgacttctgacattgttgatcacagccatggaaataaccacgtgtataactgcctaccctaagtaagagttatttttgggccaaatggaggcgagtaattttattattgttcaccattggagctggcatctggtgaaaataggtttatgtttggggtagtgttagatggaaataatgcttctaaaatatcattctgaaggataataagagtagatagtgttcatagggcaagtacccttgctaacaacagaactgaattctgtgaggtagatcatgatattctcattgatagatgaggaaacaaaggctcagagaagtcaagtgacttatctgaggttgtgcagctaggtgagtagcaaaaccaagattcaagtctaagtctgtctgattgagaccatgcctgtttcattttgttgctgtattgt

SEQ ID NO: 138143 - DNA, 1057 bp, Homo sapiens
atcatttgttttcctcatagtttttggaacagatttagtatcggtcttatttgaggtatagtatgaaacactccgttgtcagcgtaagagatgctataggagtgaaagatagcctgcagattttgctgttctgaaaaatgctttgcacttcttcaggcatttattgatggaaaagtatgtttttgtttgcttccaatacctagaaaagtaaagagttatctaactctggagaagactctctgggagatgcttacccttctctgtaaatcatgaatttgagccaatacctcagagagagccacatctgttgccataatttcctctgcagcatcattttcatctcccatgcctcatgtcatttttctcattttctccagtgttttcatgatgttttggataacaggctacagtaattaaattcaaatatggcagcccaccattacattctcatgtttaacataaaatcccaatgcacagaaacaattataattccatataattgacctgttaactcatgctaaatcatctgctattcagtctcagtgcattctttaactaaaaagttagtctgtgcctgttctgtatataaatatatttaaaagtaaaataggctaaaaatcactgttggtgctcattggaaacattttgggggcgtttagttgtggccagcaaaatagggatacattgaaaggttgatgttttgtttttgcttttctaataatttcatttaaggtttggtgtaaaaagagttgataatttatcacagatactgcttttttagagcatgattatgagagctagcatgttatcatattgagggtgtttttgaaaagaacagtttgcaaacagacaggagaagagaccagaggcagcttggccagtatggtgcttaaataagtgtttcatctcatactggattttatcaggagctgaagttggtaatgtattccttgactgatttggtttttatcacattttaaaaagtactggtgaagcaggatattttcctgaccccttcatgggacttgtgaagggagcaccctgtttactcagccca

SEQ ID NO: 138144 - DNA, 1028 bp, Homo sapiens
tgcatgcatcagaaacatgaagaaataggctattagatatactttttagcagatttagtcctagttaaaatgtcataaaggaacaattgcttcatcaagtataatcatggaagataatattttataatccctttcaccttgattaacttgcattatcattttctgtaatgcaagatggaaattgttccttaagatcatattttcgagagattatggaaaaaaataaactttgtattttcttagttaagcccatttccttctgattagaaaatacagtaaatatctcttgaacatccaaagacagaagagtaagctaaagtggaattgcggaaaaaatagaagaaaatggaataaagaaggagggccaactggagtctcaagggagaggataaaaatagatatatgtggtaagggtctagaaggtgctcttcagcttgggtacagaattgtcattttcagggtattttgccatttaaaaagtcatttaaatgacagttttgtggattatagacaagtaccattggttgaacgttaaaagtcgtcccagtaacattacatctcactggaggtgacttatctggaagcctgtgtaatctgcagcacagcagagccaagaactcaacagaagagcagtcaagatggaagttataagatctatatgataatattgacatgcttcatacataggggaatccctgagatcatcacttagaacatattcatcctcattttaaaaataattctagcaagctcagcatattagaaccacccccttagaagatacaaggaatgttatcaacttctgcaaagactatgtttggtggggttgctattagacatacaaatgacagtttgtataggaaagggaagagaaaaacacctaaaatgcaaacttacatcaaacatcacaaaggcctgataacatttagtgtagtgacaaatactcatttttcaggtcattcaacccacatttactgagaacctagtcccttcccttgtgaagtttactgtattgcctattctcagga

SEQ ID NO: 138145 - DNA, 1028 bp, Homo sapiens
gctaaatgagctacagcattcagcctggaaaatgagtcgagcttttaacttacgtgtaaacattttaaatataatactgtagtcgcctgcctggaccttccacccaagaactacaacacccagaatgcactgttttcttttccgccttccacggagggaatgcctaacttgatctcatttccacaagtaatagtcacatgacacgtttcccgtcaagatggcggatactctcccttcggagtttgatgtgatcgtaatagggacgggtatgtgtagcctggtgcttcctggacaaagtttaggaagactgtcttgtttctgttttttctgtcagtggcgagttttgggacaaacatcgtgggtcgagagtgggagggagaactgaaaggaagtgaggtagtccggagtcagcgcgggagttggcagttacagggaggggctgggacccgcagtgcttatcgccatttgagtaggggttgatctggtcgatgctgattgctgaggttggttgctgcggtgattcctgttaatttccttagagggaagtggatgtgcagtgtcatgaaatggagggtcgggattttatcaacggagacgactttggcaagacattatgattccttccttattgatttcaaggtgatattccccatcattttgtctcgccatttcataggactttttcatagatttgtatgatcttagcatacatcgcagctcagacacagcttaatcctcagttttacaagaaagatgctcaattattgcccatgtgcgtatgaatttactagggaaagtaaacggattctattttgttgagaaacctagggaattttattttgttgaggtagccattattcctgctttatggtgcttaaagcatcttgctttctaccatcaataactaaatgtgctgagaataaggtcctgagttccagttcaggtgtgtgaccttatctaactcttgttttcccgtcgtttgttcttcatgttttgggtggaaccagaaactcctctgcagtttctag

SEQ ID NO: 138146 - DNA, 1109 bp, Homo sapiens
ccagagaataagaagcaggcactgaaagaaaaagagctgaggaacgatgcctacaagaagaaagactgacagccttgaagcattacgacaaagccaaggagctggaccccagcaacatgacttacattaccaatcaagcagcggtatactttgaaaagggcgactacaataagtgttgggagctttgtgagaagtccattgaagtggggagagaaaacagagaagactatctacagattgccaaagtgtgtgctcgaattggcaactcctacttcaaagaagaaaagtacaaggatgccatccatttctataacaagtctctggcagagcaccgaactccagatgtgctcaagaaatgccagcaggcagagaaaatcctgaaggagcaagaacggctggcctacataaaccccgacctggctttagaagagaagaacaaaggcaacgagtgttttcagaaaggggactatccccacgccatgaagcattatacggaagccatcaaaaggaacccgaaagatgccaaattatacagcaatcgagctgcctgttacaccaaactcctggattccagctggcactcaaggactgtgaagaatgtatccagctagaaccgaccttcatcaagggttatacacggaaagccgttgccctggaagcgatgaaggactacaccaaagtcatggatgtgtaccggaaggcgctagacccggactccagctgtaaggaggcggcagacggctaccagcgctgtatgatggcgcagtacaaccggcaccacagccccgaagatgtgaagcgacgagccatggccgaccccgaggtgcagcagatcatgagtgacatagccatgcaccttatcctggagcagatgcagaaggaccccccaggcactcagcgaacacttaaagaatcctgtaatcgcaaagaagatccagaagctgatggatgtgggtctgattgcaattcgacaatgacttgtccatccccgcttcccttcgccctcatgcggaaagaggagcggggaccgcggcaagcagcacggagcggaagggagagcagggggagagaaggcctcacctctctgtatttatacgtaagcccaggga

SEQ ID NO: 138147 - DNA, 1057 bp, Homo sapiens
ggagtcagggcgagaaagcgagggccggaggacccacgatagagacagagtgaccatggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccaggtgagacactcgtttcttggctctcccacttctcttacccctttggcctcttctgcatgcctcaccaccctcatccaactttgtttgtagagtgagtcttaactagtttgcctctattcttcacgctgtaaatcggtggggaaagaggactagaagctttcattaatgctggtgccttctagtccacgctcagtgcaagggcttcggtctaaaaaagtcccgcaaacttgagtttgcagtcctctattgaaactttccagccttttgcccatatcttgcatggcttttggctgttcgtggttatttgttaatttctctatttggttttctttcctgctcttttgtggccgcacgggtcggataggttttcttctgaacacggataccaagggctttctctgggggctggctgagctgtaaactgggctcctaagctggcaagccagaacacagcatttggggcatgcagggggtgggaagtctagaatccatcccagagggtgattcgatcccc

SEQ ID NO: 138148 - DNA, 1009 bp, Homo sapiens
aaaactagcttgtaaattcttcaacttcaggaacagtttgatatgtcattttatcattcacagtgccaaacatagtacatggatgtaagtactgaaaatgctttcagtttgttggtttgacagtgtaactatgatttattataattaaatgtatttattctgggaagtgttcatattttaagaaaatctattgctatactttaagggtatgtcagaataacatacccctaaatagaagcctagaaaattactgttttgtctcaggcacagttgttctgatattaatgctttctactttctagatgtatgaccatctaagcctcagttttttcatctaaaaatgggaataatattagctacataaatcatgaggtttttaagattaataagcctcatgtacataaagtgcttgacacaataagatcatagaacattagctcttatttctgaaattggtgctcacaccaagaaatgtgaacacacacatatatgtacattcataacacaagaaaaagagcaaattgcagaataaaatgaaacagttttcagaaatgtttgcaaccaagactaaattaactggttgactgaatgacactgtgtgcacttcattttctaggaaattcttgtatgttgactttctaggctgatatggcagctggtaggccatttattactagttctgttgtggaaaattcagtcttgtgtgtcatttagagtttgtgacacatgtaccctcccaaggcttaatgagttgtctgcagatggaccgttatttattacagtcatgtagaataaaattgattgtcttctaaaattaatttttcatttgcctccagccttgctttaatagggcacacacagttgcctgtttgcagaaatactgtttaatcacattaatatctcagccccccaggctgaagaagatagttgtatgaacgaacagcaaaatctgtatctttaccttctttttatgattaaattatgcaaataacttatctcctgcccttct

SEQ ID NO: 138149 - DNA, 1036 bp, Homo sapiens
cttctttattagtctggctagcagtgtatctattttgttaatcttttcaaaaaaccagctcctggattcattgatttttgaagggtttttcatgtttctatctccttcagttctgcttttatcttgttatttctagtcttctgatttttttttttttttgatagagtttcgctctgttgcccaggctgcagtgcagtggtgtgatcttggctcgctgcaacttccgcctcccaggttcaagggattcttgtgcctcagcctcccgagtagctggaattacaggtacatgccaccatgcctggctaatttttgtattttttggtagagacagggtttcaccgtgttggccgggctggtcttgaactgttggcctcaagtgatctgcccacctcgacctcccaaagtgctaggattacaggagacatccttttgtttttaaaggagccaaagaagagtttgaatatatgggaatagtagtaatcaattttataaactctggctttaataagttttccacaacatgtcatttgtacatggtgatagaacttgatatacaaactcatttttcttactttataatggtaaaatgaatatttttattatttattatttacacaaaatattttaaaagatctgtgttaattggttgagatagtccccagatctctgattcagttacaccatcgagtgctaccaatatcacttgagttcttaaagcacttctacagaatctgagggctaccggacacagattttaaaacacaacatggaacaattaagtgctttataagtattatcaagaaagttggacaataatttgaatctttttttttctttattcaaaggctagaataaaggatacataaaacaatctgattatccatcaaataggggattaggtaccctttatgcaagaggcttatcttctctgagaattgaaaacaaactcagagaaatatatcatctgttgttgcattataggtagaattatggcatcactttcttaaaattccaaatttttactgttgaactttta

SEQ ID NO: 138150 - DNA, 1033 bp, Homo sapiens
gattatttttcatcataacatcataaaatttagatattagtgaaaagctggcaaacttaaattatctatttttaagtctcgttttccttgacctttctgcagcctttgaaaagattgacattctttccttccttgccttctgtgacaaaataatattatttcctctttgatttctcttcatttgttgggcccaatttacgcccatgcctaaggaataataaaattctgttcttggctctctgttcttatacttctatattcattgccaggaagagttcatgacttaaattaccacctcgtcagaaatgatccacaaacttcagaaacaatagcttcttttcttccctgtcttaaaattccagctgccttcagtattgtctacttcatgtatcccaaactgaactcagaattcccatctctaaatcagccttcataattgttcatattaatattaactgcttatataataagtatatatattcttaagaattgtgtatagcatctctatgtttccaatttaagaatctcagggttctcattcatactttctgacttttgaccccattttcaatcatttacctaatgtaacccaaactttccttttcaacatttttttccgaattttcctctttttattccccttccttattttctatttcttgtcaactcaaatgtaccacaactataatgctttgatagccttctaagtgtttcagtttcttcttctggtttatctttcacattgcttataggacactcattttctttttaaagttgtatggtatgatgttattctccttaagaatctttagtaaatccttaagagacaatttagttgcccttagtaacaaatttgaacacttgagccaagcattcagccttttcatttgattggttatcttatgtctataaaactttatctgaccttcagagttttaatttgcacatcttcagttgtcacctatgtgactcacaaattaatattttcagtttgatgtgatagaagaaggatgaaaccggtaaatcaagttac

SEQ ID NO: 138151 - DNA, 1043 bp, Homo sapiens
tgaaaatgaccatactgtcaaaagcaatctacaaattcaatgcatttcccgttgacaatcttatcacctcttaaaagctgcttcccaaattcccttctattattttgctattgctcaagttatcaatacgtattgcctttttgcatgttgatgtgcaaatttaacaatttttgaaaaccttcaacaagactagtgagattcagatttgccatctaaatagctccagcatacaaagttctaaaccatttttgacagaaggcctaaataatgatttttatgtcttcaggtcagaaattctaggggagcttggtataacgtgtgactcccagaagaatgtgttatttgtgtctgaaaaattatttttgccttaccctgtgtttgcagtcatcattggtttaagaaccagatggattttgaaaaccaggaaactctgggatgtaagagaagaataaggaaaggcaacatctataagaccctataagttacccagacatctggttggattctttatgcttactgtatcagggcaatgatgccagaaaggaagtgacacagatatttgcaaattatattatttgtaatttttgacacattggttgataagcttctaatatttatagaaaaatctattaaatcttcataaatatttttgtaagatgtattgggtttctaaaagttttctatggatattatcaatcagtgaatattaagttaaaaagaatcagctccagaaacaatccttgggtataatgggaacatcaaacttcttgttagatgatcagctttaatcaaaatatattctttgcatgtggcatttacattttagatcatagggaaattggagttctgacaattggctaacaatttctaatatgttttgtttagataaatttgaccatgtattaaagatcatcctacagagatgtaacagtgtcactttaatattcttatgcctacttcatagtaaggcaaataaaatcttcagaattgttgctggctgcctaaacatgggttactgtttattaatattttctttttcttgt

SEQ ID NO: 138152 - DNA, 1063 bp, Homo sapiens
attttttctgcttttgtttgatatggtcagctaagatgctttctctttcttttctattcaggattcttgggatggtggaatttgctctagttagtttggttagaatcaccacagatatggatacagatcggatagggtctagatagccttaaactcagacaaattctgcctcacagatatgcaatatactaattccagtctgctcctttaagaacacatgtcattggttattaggacaatcaggcaagagaatgtggatagctcactataaaccatccatagggatggttgagtactaatgacattttggcatattggaaaaaaaatatttttcagaataaagaatcgagtattgatttcctcaccatcatacaattctttttaaattttttaaatcagaaagttgttcattttttaagcttggctttgcaggttaggttttttgaaagtattcaggcacattctaaacttcccagatgtgaggaaattgaaagcacacaatgtttactgacatgtaaaactctgggacacagttttcattagttaaatttaaaatcttttcttttcttttttaccctttgtaaatgtgaccagtgaggcagattaaattagctagggaagtcagaggctaagggtcattttgcctctcatctgcacgtgcaatatcaactgaaataagtgattatttttcattacaatcaagattattatctattgtattttcataccatttcctatagtgaaattatgcgttatgctttttaaatctggtatcttaatagaaactcacgttagaaatatagaagctagccgtgagactgtgttcttaaaactaatgatctagattcatgaaaggataggaatacttagtttaatacattttccagtatatatatttatttgccatctttaacttcaaagttgtgttctttgaacaacttgttctttaggaatgaaataatctttcagaaggtacccatgttagtggtgacaagacccattaaatatttaaatagtgttattaggtacatcataaaaatacatgtagaaattgtctatttta

SEQ ID NO: 138153 - DNA, 1034 bp, Homo sapiens
gatcttttttttatttcaattgagtcttgattttcagtttatatacatatacgtgcactcatacatttgacccctgaattttatgtttttgtctacattctctttaaatccaatatacactggtttggtaatagatcagtatgtcttcgccgattaaaggcatttgaattataacattttgttcataggaggatgtaaaccctaaccttaatcagtgcatttcaggggacaagaaccaaacaaaagagaaggaatttcctaataattcatacatagcaagctttgagaaaaatctccatgcctttgcctttgactttaggttctaaataatatgacatacttccctaaggaacatcttctatctgtatcccacacgcctactcactccttcaagaaataaaactgtaaaaaaaatgtcgtttaaagtagaatcctgaaaaataaacagtaagcttctagtgtaatgtttcagaggaaagaaagatcttgtattcattgcaatttatctggaacacaacttatttgactttctgtggtcctcttgaaggtgattaatcaccaattttagagcaccaagaattgcacaatattaatgtttaattagcaaaagggaagcacctggagtgtggaggaagcgactctaagattagactatatgctttcaggttataacaaaagacaaatttaatgaccatactatttatccttagggaaaatatagttgataagttgttagatagcctcaactcaaggagagtacaagcagtaagtaaccttttgcatgcttatttcattgccgactttttaccaataaataccaatgaggcatatttgtgagctttcctatccttccaacacaaagggaggcagattgtgcttgggatgatgagacagatctatgacaccatcagtttgatgtgtcatgctttgcacttgacatgttgcttctcaccaaaataaattgatttgtcttcccccacctaattatcttcttcgtcaaccttcttgtattcaaatggaaaagattattctaa

SEQ ID NO: 138154 - DNA, 1078 bp, Homo sapiens
tcctggaaccttcactaaccagatccaggcagccttccgggagccacggcttcttgtggttagtgaccccagggctgaccaccagcctctcacggaggcatcttatgttaacctacctaccattgctctgtgtaacacagattctcctctgcactatgtggacattgccatcccatgcaacaacaagggaactcactcagtgggtttgatgtggtggatgctggctcgggaagttctgcgcatgcgtggcaccatttcccgtgaacacccatgggaggtcatgcctgatctctacttctacagagatcctgaagagattgaaaaagaagagcaggctgctgctgaaaaggcaatgaccagggaggaacttcagggtgaatggactgctccagctcctgagttcactgctactcagcctgaggttgcagactggtctgaaggtgtacaggtgccctctgtgcctattcagcagttccctactgaagactggagcactcagcgtgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaataaaataaaataaaattacttcttggtttatacatattaattgccatcatttagcattgttttccttttctgtttacttcacgaaaaacatttccagaactccaagttgctagaatagtctgattggtcaaagtttttatgaggccagtatagtagatcctaatagagttatgttgccttgacatttattttgaatatagggttggctttttcataccacaagcaaggcttagtcatccttgacacagttcccagttctctgcctcccgtagttcctcaagcagatctatccatatatctttcttatacaatcacctcctactgaccacatctttatgggacagctatatactacctgactgatccccacatcctacacaggctttgcagataagccatagcggtcacttttcagtcacagtgggaatcca

SEQ ID NO: 138155 - DNA, 1078 bp, Homo sapiens
tgttttgtaaaggtaggattcttcccccttccttttcttcttccctttgatgaaaagcttccctttcatgacgtatagctggcagcaaacttaaagttgctgtgcgtctgaaatacaggaatgggaaagaaactccgaccaagcataaaacacactcattttctagagctcagtcatttgctaagggttgaaataaactgtgcacccccactccctgccccttccccctggctccttggcctttttgtcaccggactggattctgaaggacgtccaggtaatgctgggtttcagcagctgaaagccctggcagaagggattgcaggtttcacattcttccttctcttggtattcaaaactttatttttttttttgcgagatagaaattcttgatagagagcttccagactgctggtggcagggaagaaatctggttaagagattcagaaagcagaaaattctttttctctgcgcaagcagtccacaacagcatttagctaggatttataagattcttggtggagcaaggggaggcacatcgacaaaggagagtttatataagccactggctttgagctacattgaaaaaatatgtatggcagccacgttttcttagtgggaaagaaaattattcagggaatgaaattttgaaggctaattctctccaagaatcttgcttcacataatttaaaggaggtgtcatccctgtatttgttcactgaagagtccacgaactttaattagtcacctactgtgccagacaatgtgataaatggtgtaattgaacataatggagagaggaattaatttttgttaagaggttgagaagaggttcataaaggagagagaggtctgtggctttaaaaatagtcattcctagtcagtggctagccaagaaatgtatctggaaggtcatgccctgtacagaataagtaaggaagggcatgagggcttgatgtcttgttacaaagtttagaggtatatgtgtgttttgtagacctagaacatctttgaatatttttttccagcaaattcgttaaagtaacaacaacaaaatagcctgagaaaattgggcaat

SEQ ID NO: 138156 - DNA, 1046 bp, Homo sapiens
agtgaaatggtgtgtgatcttggctcacagcgacctctgcctcctaggttcaagcaattctcctgcctcagcctcccgagtagctgggattacaggcatgtgccaccatacccagctaattttgtatttatagtacagacagggtttctccatgttggtcaggctggtctcgaactcccaacctcaggtgatcagcccatctcagcctcccaaagtgctgggattacaggcctgagccactgcacccggcccctgaatgctctcttttaattaatcattgtaaatacatatggatctgtgtgttcctaaaagggtaatgacatgccatactggccacatcaagcatgtttacaaagtataggctagtaactcatatctattttaccaaaacatctctaaaaactgctctcctgtcttaatcatattttgatcttgactttttttgtaacttttctgttagaattatctattcacaccttggctcagtatgtgctttttgttgttaataatttcatgtgtatagctttttagaaacttttactgaaagtctgtatttgcgtggaaatgaaaccaattaagaaatacaaatgacatttctttccagcttgtcagaaactgtgagagagaaattaatgacaaaagtttattgctgtgtcttcttttcagtatgcttccttcaaacttcatggcagtaaatgccaaataacctcatgtatcaaacttaaagcaagctgtgagccaggtgtcttcaactgcaggtcatatgctgagctacattcatcattttaatcttttgaattaaattctctaaaattgaataaacctcagtgagactgtggttgctaagaaattctttaattctctgactcctgaattctgtaataacttctgcctagaataaaaatggagaaagaataaggtgcaggttttggcccatagaaagcaaacaatacatgttttgagttaatttagtgttagcaacttgagagcagggaccagagccattcttttacacaaaacacaaaaatttagttcaatttttgtat

SEQ ID NO: 138157 - DNA, 1032 bp, Homo sapiens
acacctctccacctttttaatggaaattcaacagaatcaaagccacaatatagaaaatagataaaaaggctagtttctcaggatcatgtctgtaagccaggattcctgatccagagacaatggccccgatgggatggagcccgaaggcgtcatcgagagtaactggaatgagattgttgacagctttgatgacatgaacctctcggagtcccttctccgtgacatctatgcctatggttttgagaagccctctgccatccagcagcaagccattctaccttgtatcaggggttataatgtaatcgctcaagcctgatctgggactgggaaaatggccacatttgccatatcgattctgcagcagattgcattagatctaaaagccacccaggccttggtcctagcacccactcgagaattggctcagcagatacagaaggtggtcatggcactagtagactacatgggtgcctcctgtcatgcctgtatcaggggcaccaatgtgcgtgctgaggtgcagaaactgcagatggaagctccccacatcatcgtgggtacccctagctgtgtgtttgatatgcttaaccggagatacctatctcccaaatacatcaagatgtttgtactggatgaagctgacgaaatgttaagccgtggattcaaggaccagatctatgacatattccaaaagctcaacagcaacacccaggtagttttgctgtcagctacaatgccttctgatgtgcttgaggtgatcaagaagttcatgagggaccccattcggattcttgtcaagaaggaagagttgaccctggagggtatccgccaattctacatcaacgtggaacgagaggagtggaagctggacacactatgtgacttgtatgaaaccctgaccatcacccaggcagtcatcttcatcaatacccggaggaaggtggactggctcaccgagaagatgcatgctcgagatttcactgtctccgccatgcatggagatatggaccaaaaggagcgagacgtgatcacgag

SEQ ID NO: 138158 - DNA, 1312 bp, Homo sapiens
caccccgcccccaccttcgcctccccctccgcctccgcctgcggtgcacattaaagatccaaagtcatgactgactccaagtatttcacaaccaataaaaaagcagaaatatttgaactaaaagctgaactcagcaatgaaaagaaagaaaagagaaaggaggctgtgaagaaagtgattgctgttattaccgtggggaaggatgttagttctgtctttccagacatagtgaactgtatgcagactgacaatctgaaactaaagaagcttgtgtatctctacttgatgaactatgccaacagtcagccagacatggccatcatagctgtaaatagctttgtgaaggactgtgaagatcctaatcttttgattcgagccttggcagtcagaaccatggggtgcatctgggtagacaaaattacagaatatctctctgagcccctcctcaagtgcttagaggatgaggatccctatgttcggaaaacagcagcagtatgcgtggcaaaactccatgacatcaacgcccaaatggtggaagatcagggatttttggattctctatggggtctcatagcagattcaaatccaatggtggtggctaatgctgtagcagcattatctgaaatcagtgagtctcacccaaacagcaacttactcaatctgaacacacagtacattaataagctgcggacagccctgaataagtgcactgaaggggccagattttcatgctggactgcctgtctaattacaaccctaaaaatgatcggaaggctcagagcatctgtgagcgggtaactccccagctatcccatgccaactcagcagtggtgctttcagcggtaaaagtactaatgaagtttctagaattgttacctaaggattctgactactacaatatgctgctgaagaagttagcccctccacttgtcactttgatgtctggggagtcagaagtgcactatgtctccctgaggaacatcaacttaattgtccagaaaaggcctgaaatcttgaagcaggaaatcaaagtcttctttgtgaagtacaatgatcccatctatgttaaactagagaagttggacatcaggattcatttggcatcacaagccaacattgctcaggttctggcagaactgaaggaatatgccacagaggtgaatgttgactttgttcgaaaagctgtgtgggccactggacggtgtgccatcaaggtggagcaatctgcagagcactgtgtaagcacattgcttgatctaatcaagaccaaagtgaattatgtggtccaagaagtgattgttgtcatcaggga

SEQ ID NO: 138159 - DNA, 1364 bp, Homo sapiens
cctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagt

SEQ ID NO: 138160 - DNA, 1006 bp, Homo sapiens
cttttccccttttgtaactgcagatatgtggtaaaattatattagaaaattgaattaatattaaatattcatgtattcttcaaaggatactttgaaatatttatatctgaatgaatgatttaaatttttgttttactaactgtactattttttcacatagttcagtatcaacttttgtctcatgttgacattacccaatatttatttcaactccccttattatgtagcccattttgcttattaaaagtaaaacatatataaagttcccactttagtgcctggcacacagtaagtgatcaacaaattttacctgtttttatttttatacatctatatgtagctataagttatcctcatgtcttactagattattcatatagagaataaatatcttgtaacattaccatataatttaccctcaaacactccatctgtatcattttcctacatatatctagaaaaaatgttttgaattggaatagaaaagaaatgcactaccatttatttattgcttactaagacaatcatcatgagattgtaatattgttgtgggatgaatgtttgtgactccaaaaaattcatatgttgaaatcttaatccctaatgtgatggtatttggagataggacctttgggaggtaattaggccataagggtgagactctcgtgaaggcattggtgccctttacaaaaagagatgagaaaaagcatgtttcttctctctattctccatcatatgaatgagaaaatgaccatctgtaaatgaggaaaagtgcccttaccagacaccagatttgctgacactatgattttggacttactagcctccaaaactgtgagaaataaatgtttatttttaagccattctgcctatagtattctgttagaacagaccaaactgactaagaaatatatcatttactattcacagcaaaactcaatgagtttggtcttgttattaatgaaattttacagataaagtgaagtacagagaactttaatagcat

SEQ ID NO: 138161 - DNA, 1101 bp, Homo sapiens
tgaagaattcatacagatgactgcaaaatgaagacctattttcaactcctttttctcccttctagaaaaatcaaattgaatcttttacttacctcttataaaaaaaatagaaaaaagaaaaaagttcatttatttatttctacatagcaaaactgaatgtcagaagtaccttctgaccacacaaaaagtctgtatgtattggttgatggtcctgccccctgaagatcaagctacacatcagttttacaatataaatacttgtactaccttaatgaaaaggactccttaaagtgccatttgctaatgattaatacactgttcggggtggccagttttttatgtatgcaaattgacgattgagcacagtcaggcatttgtattaaaaacgaaaaatggaaaaacaaattcaaaacctattcaaatgtgttctagttcaatttgttcagtataaattgtcatagctggtttactgaaaacaaacacatttaaaattcgtttacctcaggatgacatgcagaaaaatgggtgaaggataaaccatgagacatggcctcactagtaggattggcctcttttacttcatgtactctgacccatggtgacaatgacacaccctggtggcatgcccatgtatgtttgtttagcattgtctgcattgttctagagtgaaacaggtgtcaggttgtcactgtccacacaaaattttaataggaaacctttaccaatggagcatttttggactctctctttttaaaaccttctgaaccataacttggagcctgcagaataggctgtggctgtagacttcagcacaaccgtcaacattgctgttcaagaaattacaatttacatccattccaagttgtaaatgatagtatttttttccaattaaaaacacccttaagttaaaagtaaagactgaaatcatacagtgtcttctttctgatgatagtaaaattaagctagatactaataatgcaaaatttaaaaactcatatttttgaaaattaaaagcatttacttttattaatcctcaaatcaaaaatcccatgatatattttagaaaatttttgaaacaaaagaatataaaatgtaatgttt

SEQ ID NO: 138162 - DNA, 1035 bp, Homo sapiens
ccgggcctcagtttccccatctctaaaatgggctacccttcctttctcttgactagttccctccctgttctcgctgggccactaggaagtgaaatcagtgcctaaccgcagctgaaagtgctctgttaggctccagtcaccgcgccgggcatgctcagtagctggggccggctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattcc

SEQ ID NO: 138163 - DNA, 1225 bp, Homo sapiens
cttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattc

SEQ ID NO: 138164 - DNA, 1555 bp, Homo sapiens
taatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaa

SEQ ID NO: 138165 - DNA, 1162 bp, Homo sapiens
gtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttattt

SEQ ID NO: 138166 - DNA, 1095 bp, Homo sapiens
ggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccact

SEQ ID NO: 138167 - DNA, 1070 bp, Homo sapiens
gtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaa

SEQ ID NO: 138168 - DNA, 2763 bp, Homo sapiens
atatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagaga

SEQ ID NO: 138169 - DNA, 1537 bp, Homo sapiens
gtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatg

SEQ ID NO: 138170 - DNA, 1002 bp, Homo sapiens
tgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggc

SEQ ID NO: 138171 - DNA, 2617 bp, Homo sapiens
cctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatatt

SEQ ID NO: 138172 - DNA, 1020 bp, Homo sapiens
tgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctcccca

SEQ ID NO: 138173 - DNA, 1029 bp, Homo sapiens
catggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgc

SEQ ID NO: 138174 - DNA, 1076 bp, Homo sapiens
ctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgg

SEQ ID NO: 138175 - DNA, 2015 bp, Homo sapiens
taattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatc

SEQ ID NO: 138176 - DNA, 1468 bp, Homo sapiens
acatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagc

SEQ ID NO: 138177 - DNA, 1038 bp, Homo sapiens
tcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgttt

SEQ ID NO: 138178 - DNA, 1075 bp, Homo sapiens
cgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgac

SEQ ID NO: 138179 - DNA, 4456 bp, Homo sapiens
attccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgc

SEQ ID NO: 138180 - DNA, 1067 bp, Homo sapiens
attggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgtttta

SEQ ID NO: 138181 - DNA, 1043 bp, Homo sapiens
attatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatct

SEQ ID NO: 138182 - DNA, 4703 bp, Homo sapiens
cttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctga

SEQ ID NO: 138183 - DNA, 1686 bp, Homo sapiens
atgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcaggga

SEQ ID NO: 138184 - DNA, 1796 bp, Homo sapiens
tgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtataga

SEQ ID NO: 138185 - DNA, 1033 bp, Homo sapiens
aatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttgg

SEQ ID NO: 138186 - DNA, 1051 bp, Homo sapiens
taaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaa

SEQ ID NO: 138187 - DNA, 1005 bp, Homo sapiens
gttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaa

SEQ ID NO: 138188 - DNA, 1027 bp, Homo sapiens
gtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctc

SEQ ID NO: 138189 - DNA, 1912 bp, Homo sapiens
ggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagta

SEQ ID NO: 138190 - DNA, 1315 bp, Homo sapiens
tctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtc

SEQ ID NO: 138191 - DNA, 1335 bp, Homo sapiens
cctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacc

SEQ ID NO: 138192 - DNA, 2084 bp, Homo sapiens
ctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgc

SEQ ID NO: 138193 - DNA, 1345 bp, Homo sapiens
aaaatgcagaaaccagaagccagaaagcaaaagtacattggatcatatatagacaggacaaatgaaatataatttctttgtttcttttttttttttttttttgagatggagtttcactactgttgcccaggctggagtgcaatggcacaatctcagctcactgcaacctccgcctcccaggtttcagtgattctcctgcctcagcctcccaagtagctgagattacaggcatgcgccaccactcccagctaattttgtatttttagtagagacagggtttctccatgttagtcaggctggtctcaaactcccgacctcaggttatctgcccacctcagcctcccaaagtgctgggattacaggcatgagccaccacacccgactatgaaatataatttctaatctttacattttcaaattacaagccctcaatgttctaatttcagcatcagtggtgaaatgccatactagaaaactgaggatttatctgtaaaattacatataagtaaaaggaaaattcccaaaacagattataggattctggatactgaggtagaaatttgtgacacgactattaggtttctgcatagaataatcaccaaacatcctgtaaaactacacctgtgtttataccagtgatagcagcaacataacaaactaagagctcgctattcaaatttctcttgccaagctttctggttttcccaattatagtgatggtgaataatggggaaagtcagcaacaagggcagcttctacataattggaaaaggtaatttcctatactatgtgatttatgggctaccctaaggtcttatctgccttcccctttatctaaccagaaataatcagcattattccactcaatagataataacatcagaagaaacgtttccaaagagtcactgttacacagctatacattacctaggattttccattgaaccttctcatattctctcttatttgatttttagattagaaaatctgcacttaaaaagaatcaggctcaggggctaaagtggtgggatattttcaatctaagtcaatttcataaggtatagaaacattacagtgaaatactccaccccgtggcagcatggtaggtaccccagtgagagctctgacagtcaaacaaaagtttgacgtagcacttccccagagtggactaagttctctttagcatggtccccctatattaccaaaggaataaaatgttaatatatcaagtttttatttagttttgaccacctaaataatgcaggcactgaatcctttcaggagtaaagtgagaaacaagtaaaaaaaaacctactaaatataaccataccagatatcttcttgg

SEQ ID NO: 138194 - DNA, 2015 bp, Homo sapiens
aaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgata

SEQ ID NO: 138195 - DNA, 1076 bp, Homo sapiens
cttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaa

SEQ ID NO: 138196 - DNA, 1449 bp, Homo sapiens
catctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctc

SEQ ID NO: 138197 - DNA, 1286 bp, Homo sapiens
ttgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttat

SEQ ID NO: 138198 - DNA, 2526 bp, Homo sapiens
tgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgt

SEQ ID NO: 138199 - DNA, 2107 bp, Homo sapiens
aaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagc

SEQ ID NO: 138200 - DNA, 1041 bp, Homo sapiens
tttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataa

SEQ ID NO: 138201 - DNA, 1048 bp, Homo sapiens
tttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttat

SEQ ID NO: 138202 - DNA, 1869 bp, Homo sapiens
tgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgt

SEQ ID NO: 138203 - DNA, 1701 bp, Homo sapiens
tatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaa

SEQ ID NO: 138204 - DNA, 1617 bp, Homo sapiens
gaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaact

SEQ ID NO: 138205 - DNA, 1809 bp, Homo sapiens
gtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgttt

SEQ ID NO: 138206 - DNA, 1283 bp, Homo sapiens
ctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgac

SEQ ID NO: 138207 - DNA, 1494 bp, Homo sapiens
agtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggtt

SEQ ID NO: 138208 - DNA, 1069 bp, Homo sapiens
atatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggt

SEQ ID NO: 138209 - DNA, 1040 bp, Homo sapiens
actgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatact

SEQ ID NO: 138210 - DNA, 1106 bp, Homo sapiens
ttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggta

SEQ ID NO: 138211 - DNA, 2059 bp, Homo sapiens
tgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagacct

SEQ ID NO: 138212 - DNA, 1047 bp, Homo sapiens
ctagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatat

SEQ ID NO: 138213 - DNA, 1276 bp, Homo sapiens
tttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccc

SEQ ID NO: 138214 - DNA, 1082 bp, Homo sapiens
ataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcac

SEQ ID NO: 138215 - DNA, 2035 bp, Homo sapiens
gtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgttt

SEQ ID NO: 138216 - DNA, 2490 bp, Homo sapiens
tcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttg

SEQ ID NO: 138217 - DNA, 1832 bp, Homo sapiens
tgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggt

SEQ ID NO: 138218 - DNA, 1636 bp, Homo sapiens
gcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaata

SEQ ID NO: 138219 - DNA, 1351 bp, Homo sapiens
tcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttg

SEQ ID NO: 138220 - DNA, 1344 bp, Homo sapiens
gacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaa

SEQ ID NO: 138221 - DNA, 1251 bp, Homo sapiens
tctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctaga

SEQ ID NO: 138222 - DNA, 1190 bp, Homo sapiens
gcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggc

SEQ ID NO: 138223 - DNA, 1082 bp, Homo sapiens
aaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttag

SEQ ID NO: 138224 - DNA, 1030 bp, Homo sapiens
tggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgt

SEQ ID NO: 138225 - DNA, 1787 bp, Homo sapiens
cgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagag

SEQ ID NO: 138226 - DNA, 1530 bp, Homo sapiens
ggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctatt

SEQ ID NO: 138227 - DNA, 1062 bp, Homo sapiens
acggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctc

SEQ ID NO: 138228 - DNA, 1049 bp, Homo sapiens
tagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcagg

SEQ ID NO: 138229 - DNA, 1050 bp, Homo sapiens
ggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagag

SEQ ID NO: 138230 - DNA, 1021 bp, Homo sapiens
ctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaat

SEQ ID NO: 138231 - DNA, 1036 bp, Homo sapiens
tagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcat

SEQ ID NO: 138232 - DNA, 1853 bp, Homo sapiens
taaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcaggg

SEQ ID NO: 138233 - DNA, 1078 bp, Homo sapiens
atgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagt

SEQ ID NO: 138234 - DNA, 1064 bp, Homo sapiens
ttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaaca

SEQ ID NO: 138235 - DNA, 1484 bp, Homo sapiens
actattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtagg

SEQ ID NO: 138236 - DNA, 1014 bp, Homo sapiens
agtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaac

SEQ ID NO: 138237 - DNA, 2142 bp, Homo sapiens
agatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaat

SEQ ID NO: 138238 - DNA, 1025 bp, Homo sapiens
taggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttcta

SEQ ID NO: 138239 - DNA, 1102 bp, Homo sapiens
ggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctg

SEQ ID NO: 138240 - DNA, 1106 bp, Homo sapiens
aataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactc

SEQ ID NO: 138241 - DNA, 1095 bp, Homo sapiens
aaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgattta

SEQ ID NO: 138242 - DNA, 1035 bp, Homo sapiens
tgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaac

SEQ ID NO: 138243 - DNA, 1033 bp, Homo sapiens
agaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaagg

SEQ ID NO: 138244 - DNA, 1055 bp, Homo sapiens
gttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtc

SEQ ID NO: 138245 - DNA, 1024 bp, Homo sapiens
tgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtg

SEQ ID NO: 138246 - DNA, 1064 bp, Homo sapiens
tggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaat

SEQ ID NO: 138247 - DNA, 1015 bp, Homo sapiens
actaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggat

SEQ ID NO: 138248 - DNA, 1045 bp, Homo sapiens
aggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttga

SEQ ID NO: 138249 - DNA, 1049 bp, Homo sapiens
taaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaa

SEQ ID NO: 138250 - DNA, 1181 bp, Homo sapiens
ttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagca

SEQ ID NO: 138251 - DNA, 1053 bp, Homo sapiens
agaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtc

SEQ ID NO: 138252 - DNA, 1049 bp, Homo sapiens
tatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatt

SEQ ID NO: 138253 - DNA, 1034 bp, Homo sapiens
ctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagg

SEQ ID NO: 138254 - DNA, 1518 bp, Homo sapiens
tgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcct

SEQ ID NO: 138255 - DNA, 1472 bp, Homo sapiens
ctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgata

SEQ ID NO: 138256 - DNA, 1020 bp, Homo sapiens
atttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgacc

SEQ ID NO: 138257 - DNA, 1130 bp, Homo sapiens
gcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgt

SEQ ID NO: 138258 - DNA, 2164 bp, Homo sapiens
tgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgatt

SEQ ID NO: 138259 - DNA, 1306 bp, Homo sapiens
atgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacat

SEQ ID NO: 138260 - DNA, 1546 bp, Homo sapiens
catctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaa

SEQ ID NO: 138261 - DNA, 1052 bp, Homo sapiens
taataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctga

SEQ ID NO: 138262 - DNA, 1085 bp, Homo sapiens
aagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcg

SEQ ID NO: 138263 - DNA, 1059 bp, Homo sapiens
aatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagact

SEQ ID NO: 138264 - DNA, 1463 bp, Homo sapiens
aataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaat

SEQ ID NO: 138265 - DNA, 2051 bp, Homo sapiens
attggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctat

SEQ ID NO: 138266 - DNA, 1031 bp, Homo sapiens
ggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgtta

SEQ ID NO: 138267 - DNA, 1070 bp, Homo sapiens
gttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttca

SEQ ID NO: 138268 - DNA, 1077 bp, Homo sapiens
cacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggcc

SEQ ID NO: 138269 - DNA, 1088 bp, Homo sapiens
caaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagct

SEQ ID NO: 138270 - DNA, 1031 bp, Homo sapiens
taatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgc

SEQ ID NO: 138271 - DNA, 1432 bp, Homo sapiens
tcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttga

SEQ ID NO: 138272 - DNA, 1033 bp, Homo sapiens
ggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgg

SEQ ID NO: 138273 - DNA, 1081 bp, Homo sapiens
tttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggc

SEQ ID NO: 138274 - DNA, 1006 bp, Homo sapiens
gcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattata

SEQ ID NO: 138275 - DNA, 1030 bp, Homo sapiens
gcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtct

SEQ ID NO: 138276 - DNA, 1678 bp, Homo sapiens
cagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccac

SEQ ID NO: 138277 - DNA, 1050 bp, Homo sapiens
attctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgg

SEQ ID NO: 138278 - DNA, 1007 bp, Homo sapiens
aatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttg

SEQ ID NO: 138279 - DNA, 1026 bp, Homo sapiens
tggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttt

SEQ ID NO: 138280 - DNA, 1126 bp, Homo sapiens
attaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggat

SEQ ID NO: 138281 - DNA, 1010 bp, Homo sapiens
aaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatcc

SEQ ID NO: 138282 - DNA, 1367 bp, Homo sapiens
cggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgca

SEQ ID NO: 138283 - DNA, 2012 bp, Homo sapiens
ctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcg

SEQ ID NO: 138284 - DNA, 1102 bp, Homo sapiens
ctcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagg

SEQ ID NO: 138285 - DNA, 1001 bp, Homo sapiens
ggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgc

SEQ ID NO: 138286 - DNA, 1050 bp, Homo sapiens
tttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttgga

SEQ ID NO: 138287 - DNA, 1069 bp, Homo sapiens
tattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattct

SEQ ID NO: 138288 - DNA, 1044 bp, Homo sapiens
tcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatg

SEQ ID NO: 138289 - DNA, 1848 bp, Homo sapiens
ctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatgggg

SEQ ID NO: 138290 - DNA, 1336 bp, Homo sapiens
agcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgat

SEQ ID NO: 138291 - DNA, 1023 bp, Homo sapiens
aagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggat

SEQ ID NO: 138292 - DNA, 1496 bp, Homo sapiens
tatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtgg

SEQ ID NO: 138293 - DNA, 2759 bp, Homo sapiens
agaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctaga

SEQ ID NO: 138294 - DNA, 1181 bp, Homo sapiens
ttttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaaga

SEQ ID NO: 138295 - DNA, 1065 bp, Homo sapiens
atagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacct

SEQ ID NO: 138296 - DNA, 1019 bp, Homo sapiens
ctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgct

SEQ ID NO: 138297 - DNA, 1079 bp, Homo sapiens
taccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaatta

SEQ ID NO: 138298 - DNA, 1502 bp, Homo sapiens
gtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattc

SEQ ID NO: 138299 - DNA, 1016 bp, Homo sapiens
aaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgctatttccttacaatgttccctttcacttaggggctcatgcaaaagatttatgatttccttcagattttctttggtcatagtgctctaaacacttgtagctgaatttttagttcttacctcaaataagtctgataacactactacatttttaaaaaatgagtgatataatttgtagaaatagtcactggaatgcttttaagagatttcaaatcatagagttgaaaattcatgctgtgctctaggcattattgatcctgagccatctcatgcaggtagatataaatcctcttcttaaagatctctggtgaaaaaacactttcaggcttttccatagtaatttacctcattgctgaaaatgtttacagataggtgtatgcacattgttaggaccaatgacataatgcccagttgcagtgaatcaagctaataaaataataatcctttttaaaattataatcttcaaagggtttccgaaaatcacttataggaagtttatgtgattttgctgtttctctaggaaaggcagttacgtttgaatatttaaatgatcaggccttgtgtgggtcacacagggatttttattttgcatttggattccctttatggtttaaatcacagatctctaccttaaatgcaaatgaatggagtgttgagaattgacataattttttaaattgccatagttatttccagggagctttatacctcagtataagtatcttatcctgtattataattgcttgct

SEQ ID NO: 138300 - DNA, 1364 bp, Homo sapiens
gcagagattttaaagaacagggtaaggccaggcatggtggcttatgcctgtaatcccagcactttgggaggccgaggcgggtagatcacctgaggtgaggagttcgagaccagcctggctgacatggtgaaaccctgtctctactaaaaatacaaaacattagccgggtgtggtggcgggtgcctgtaatcccagctactcgagaggctgagacaggagaatccctcgaacccaagagacagaggttgcagtgagcagagatcgtgccactgcactccagcctgagtgacagagcatgactccatctcaaaaaaaaaaaaaattaataatagtaataataaagaacagggtagatgattatcgttctgggatggactagataacttctagtattgtgcagcccagtgattccttgaatctcctctaaatgtaaaccttgctttattagaaatgagaaatctgatttgtggatatgaagtctccgcatcccccataactccttgattctcctttgccaggacctccccccaccctccacttttggtttaatctagttcttctaattaaatatgagataattaaagttcacagagtttaaacccagcaggtttgatttaatgataaaaatcttggtttgtcagcttttcaaggcataatcctggctgctgccttatctgacaggtagtcagcctagcaggtctgaggatgaaaaccagagcatctcatcttttcaggcatgacttgctatttatcttctgaggcataatttacaattgccctatagaaaatgggtagggttaaataagtagaaaaggtctccttttgctttggctcaattaattcatttcctatgcggttgtcgatgactaggcttacaaagtagacagatgtatttcaaatgaggagaaaatgccccaaacatagcatatttgattattgtaaattattcctttactcactgaatatgtaaagtatgtaaatttagtcctgctgtcaaaaggtagctctgtaccattagtttctgcagcagacaaggcctgctgcatcctgtactgcattttcagagagataattctaatgacagcttgagcaattgccttaatgagccagaaaggtgttcttttttattcgtgtttagctgcttagagtcatctgaaatagagatcatctgtagatattacagagtgaaaaaagacatgggttatcttattaatgtgtttctccaagcatgctaagaatgaaccatcaatcaggtatttgccaagaaaatagcttgttgtcagttctgtataggtgatatggcaacctgaaatgcaagtttaggttctaattatcatgctagctaagtaaaagagttgtcaagt

SEQ ID NO: 138301 - DNA, 1051 bp, Homo sapiens
aaattagccaggagtcccagctactctggaggctgaggcaggagaatggcttgagcctgggaggcagaggttgcagtgagccaagattgtgccattgcactccaacctgggtgacagagcaagactccgtctaaaaaaaaatctatctatctatctatatatatatatgtgtgtgtgtgtgtatacatgtatatatatacacacatcctttttagtttaaataatccattgtattagaaagaaaaagttacactagtgaatcagctctacagttttcagaaggtgaatcaaataattactaaattgaagtacagtaagatgaactatcatgtgaaattatatttccctataaatttcttatgaaatcttgcattgatttgtgcatgtgtgtttgactaatgaagtgaagtgtgggactactatagaatttagatttaatgcctaggtaatgggtacttgtccaattacaggtcttcatgaagtttctaatgaaaaaaacactaaagagctcttcttctcagctgtatcataaatgacaaaaatctcagctccccaggcctaagtcagtaataagtggaagagtgactcttctagttactaattcatttgtggagttttccaaagttagcttgcattgtaagtttcttataaggaggatcatttcatgagagttggttttttgctattgtcacaattgtgtaatcgtccccatagaagcatgatatgcatacacttaacacattcaatttgtaattcttcttgctagtaaagccaaaaattctatcccatgcttagacatccatggaggtgatcattataatgcattatttgtcaaattttattctttttcaaaactccaaagaaaatgtgacattctactatgtctttgaatctctgattatatacatttgtttatgttaatctataacatgttacttggtttctttgaagctctgttttctagttgatgatgctaaaatttatgttaattcacatctaggtgtacttgaaatcacctaatttgaaattgcagttcttaaacagctctaag

SEQ ID NO: 138302 - DNA, 1386 bp, Homo sapiens
tatactacatatttcctttttgaagcaggaaagaatgaactgtgcatcacagttctgttatctatagcaaatctgtaactcctgaatcctttcttcccgaccccacccaccctgggggctacttctctaccattagtttatggtcatcagagaattacaacaagtagagcagcacagccttgtgctttctactctaaaggtattgcttccccagacaactgaaacttgagttaagcccatgccccaggaaaagaaaggtcaggaagttattttgctttctggaaggctacagagatgagagcaaaggagatgaagagccttggcatctactccagaattgcttttgactgccagacttcgatctaatctctatggcacatcatcagcattcactgtgtacctcatacacaaaagcagaagagtagctggatttctttaaaattgtgcccttcatttgtttcccttgcatgttctatttccccaattaactttgtgagccctgggcaaattagttaacctcactgggcctcaaaggcctcatctataaaatgaatggtttagaatagatgatctttgatcccttccattgcaagcattctatgctgtgaaacctcaaggctgtaaactatatgagagtaggagccaatttttttttttatcattttttttatctccccacagggcctaatgtaactttgactgtactaccttgctttcactatgtgaagtagattttgaagacagctctaatatgtactaaactcgattagaaattagacatcccattttagttgaaagtcagcttattaggtagatgttatatgaacttgcttatttcaaaaggaaaaaaaattctgggaaatgaatcattgggatggaattaagtaatcccatttaggaaaatagtactttaataataggctatgaaagagttatgggttgaattgtcacccaaaaaggtatgtttaagtcctaatccccagtatctgtgaataggaccttgtttgtgattggaggctttgaaaatgtaatcaagttaagatatggtcatactggatgagggtgcaccctaaatccaatgactggtgtccttataagtaggccatgtgggacacaaagacacacagggagaatgccacgtaactgtggaagcatagactggagtgatgcgactgccaaggaatcccaaggattgatggctaccataaaaagctaggagagagaagtgcaacaaattctccatcagaaccttcaaaagaaccaaccctgccctgtaccttaacttcagaattcttgtgtccagagctgtgagagaatacatttctgttattgtaagtcacccagtctgtcataatttattatggcagacctaggaaactaatacag

SEQ ID NO: 138303 - DNA, 1444 bp, Homo sapiens
aaaaaaaaaagaaaagaaaagattaaatatcatccccatcacttcatcttacccagtggggaaacaaactattttaaactaaagtagtagcacatgcttactggcatagagcagaacattcttattaataccaactctatgtaaataactagatatatacattattcacatctgaatgtgtaattaaagaccatttaggtactgaacttgatgaatgagagggaaaaatgtctgggatgtcaatgtgatactgtaaataccgaaggcaattcacagtgtgactagtagcaccacctgtctcacacccaaagataattcatcaaataataccacgtctaaactggcagattctttgtcttcatagcctaaaatagagaaaagatcactagattttttttttaaaaatctaatcccaaaacttaccagctctgttacttcagacaaacctcttaaccctcagtgcccccatctataaaataaggataattatatttgccccacctcacagccttgaagtgaaaagaaatgtggtaatgtatccaggaagcatttataaactaaatgctatacaaacaaatggtgttatttcatacctattcaaatggactgaaagtcatttgaaaatgttatcaacttttgaccgtgattgtattctcattttccaaggaagtccaaaagatagattaaatttgaattcttcattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtatttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgaaaataaaaaaaaaaaaagaaataatgctattagcaggctatgaatagagatcagcatttcttttcaagaaaaataaactgcatttaatttgggcttctcttaaaaaaataagatacccggtgtaatttaaaataaaaatattgatggaaatggcaatgtctttcataattattattcaattgcaatgttatatactccataacttaagcaaatgagtagttttgactactggaaaatagcatttgaaagtcaattatggaacttccagcacacctatagttttagtgtcctaaacttatcctctaaagttact

SEQ ID NO: 138304 - DNA, 1024 bp, Homo sapiens
ttacaaaaggccatctggaattccctttctacacatcactgttaaagcaaaaaactatatttaagtggtaccaaggtatcaggattccctgcagacagtttgagatctaatataaaatcaaaaaccccttataggccactggtctaaatgatgacagtaaaaaattcccaagactattaagttttattaatgaatatgatggaaaataagatcttggaatgtgaattaaatgtttttaaggtgatgagtgggtaagaaagagaggtgataaaagtttttgaaaacttgttttcaaagcaatactattacatattaaatatacagtttaaacttttctcatcctgctgacaaatacatacctgagccaagattactgttttgtttcattttaaccattcccctacatggtaatatctatagtgaatgaccatttctggagagttttactttgatatgttagcacatcattacctgttaggtagccccaaaatgtaaataaattatacctcattccatattgtcaaaacatagaaacagcaacaaagatacctaaatgaaagaagctgtgattgtttttcaaaaccaaagaagagaagtgtaagaaaagcattgaatttaaggggcagaaactatcccagaaagttactgctagaattcaaatactaaagaaagtaatagaattatacctttataaagatcaagggtaacaaatttgaattggtaccttttttttttttttttttttttttgagaaggagtttcgctctcgttgcccaggctggagtgcaatggcgcgatcttggctcaccacaacctccatctcccgggctcaagagattctcctccctcagccttctgagtagctgggattacaggcatgtgccaccacgcccagctaattttgtatttttagtagagacagggtttctccatgttagtcaggctggtctcaaactcctgacctcaggtgatccacccacctcggcctcccaaagtgctgggattacaggcgtgagccaccacg

SEQ ID NO: 138305 - DNA, 1184 bp, Homo sapiens
tgccaactatggtcagtgggccaaatccagcccatggactagagctaaaatgttgtttatatctttaaagagttgtaaaaacaaagaagaatatacagcagacaccatatgtggcccacaaaggctaaaatatttgccatctggcccttcacaaggaaaatgttgctggcctttcttccagatgctgaggatacaccagtgaacaaaaccgacaaaaaaaaaaaaaaaaaaaaaaaaatccctaccttcagagagcataaattctatttttttacaacaattttatgcagaatacgcatcttatttttgtaaatatgcacaatatttacatatagtacatactcaatatttgtgaaatgaatgaataagtcatagagtccatcatccaatattatataatattggcaaatatttccatatgatgtaataaaatgttgcattttttaaatctttatatgaagaatttttccctagataatttttagaccaaaaactcaaacactacttacttgtcaagacattttattctggtacttagtaatgatttcccatcttaatgtaacttttattcatgatgaggtcctgattatctagcctccttatgagaggtaatcataattatatttgattctgaaagctttctgaaatggtgattctttcataagagatcattttgtatacgtgacagttaaaacaatgagttagtttttcagagtttctatccttgaattctacaagtttgtgatgtttatagcttgaattcagataaaaccattttgctccacatttgaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatcattaccagcaagcaatt

SEQ ID NO: 138306 - DNA, 2221 bp, Homo sapiens
ttcaaacacatatcactatggtagttcacagtaacatggaagaaatcattacagagcatttgaactggataattttatttattcattgtggtcagacagcaagtctaattctgttgtcatttttatacaggtgatggtttaagaaaaaaaattatttacagacctcaacagcctatctcgatttctgtatttttcttatcaatgaaataataaagatgagcgcttcaaactatgcctctcacaactttcacaaagcatggcaataatctataatttatgtcactctcacctgtaaggctgagaatcattgacagaacctaaagggagggaaaaaagtcatctttctagataaagtgatgatagtttttcccagcttttaaaaaaatatatgcaaggaatttgtggtgaaatacaatagcattttaataaattgttattaacttgtattactaataaaaatttaagcctattgatctcacctgagaagcttaaaacattgaccagctaaggctttagtcacacatattcttagagtttctgagaaaccaatagcttttatgattttaaaaaatctatttacaaacatcatcttcacattcctctagccctgctttttttaaaggaaaccctacaggcaaaaatgcaatttttccaaagttggacatatggctgatgtcagaaccagcaaaatcatgttatacaaagccaaacgctgagttaaacctcccaatgctgatgttcatcagaccccagaataggtgtctgttacaggatgagcaagatgttagtcatagaagtagaactctgtggagatataactactcacctgcaaaatcaggtggctctgaaaatgaatagcactgtagcgttgggccaattcctgctgcccttggcactgggaatgcaatcttgtatggcaaatcaaatgagcagaaggcttggggccagaatactatcaagctcttctcaaactttaaatggatgagaagtcctgctcactgccatggaacatggcatggattttaagtgcctagtaggccattttattttgttctgttctttcttatttttggtaagcagagctggcagtatgagataaacttacataaacagtgagttcttgatttttatatttctcatatagatccaaaatcagcagcttcatttacacgtagctgtaaaactagaggagataaagtaatagcgtaggattatgttgaaaaatcaggatggggaagaatccccagaagagcttgacattttattaatccctactgaaaaacatgttccaaaatttttaaaaatgtccttctaatagcatatatatatgtatgtatgtgtgtgtatgtgtgtatatatatatatgtgtgtgtatatatatgtttgtgtgtgtatatatatatgtgtgtatatatatatatagttttttccatctagttttctctcagtagtgtctatttaatctagaaagcttctcaagccatgaacttctctatggattagattctgtgtattagagcgcaagtgagtatagctttagtccttgaatgagcagggaaactcctcaatgagaaaatatgggattttccaagaaattcctccagggcccttcctattcttaatcttttctctgtagctgaggataatagctgcataccttctagctcccccaattctagaaacaagaataataaagccttgacaatccatgagaagactttaatctgccctcaggattcccgattccagctcagtttctaatgttcctggatggtgactcatatctcaaaggcaattttggatttaaaatggttttccaaatctacataaagaatttctggattgtttgctgttttaaattagccaaaccaccctttctctctaacagcctgtataattgagagttggctatacattgtttgatacctgtaaaaagtaattgaacattctgaatagtgtattttgatgactgcaatttcaggtgcccaagcttgaccaggttgcttcgtttttgctcacagtggtattcagatatgcccctatttaaacaacccaataaatgaaaataatattttacaagattgataaatgaaggtgatttttttcccctcagagatctcttacttttaaaagagattcattgtattgttagtcatgtcctccgttgcattgaaaacatctgtttcaaaaaaaattcacatttatgggttattttcctcaa

SEQ ID NO: 138307 - DNA, 1033 bp, Homo sapiens
ataaacccaagcctcgtgtgatcttgttactctctatacagaacttacatccttgattagtatgtagactatcagtttgtttatttttttaagagatggggtctcgctatgttgcccagcctggtctcaaacttctggactcaagcagtctgcctgcctggtcctcccacagtgctgggattataagcgtgagccaccacacatctggcccagactttcaagtttcatagtgaaagtgtctggcagattaatgagttgttgatgcattcagtcaagaaatacttctgaactatgaggttcataatttgaggtttatctggttaaaatcatgactgctttcattagtgctttaattagttgaattctgtatttcagagaggcaaaactaggaactgcattttactgataaaattgagttatactatgccttttaggcaaatggaaccctcatttttttttgtccttatggtcattattaatattttgtttgttcttatttttgcttggagaaggagaactatcattgcattactgcaaacagtatatttatttacctcctgcccatgaacacttctttccctatttggagaaataagatactgtttgttcacagacctccctagtggtctgtctgttaagcagcggcagtcctgaactaagggcacaagaaaatggagctggtaatcacaagcaaataatgcaagacttttaacactttacatgacagattcaggtggggcttgcctactttattatccaaggtgttgctatttcctttcatgcctttggagatcccagaagaaggggagctagctgagtcaaacctctgtctcacagggctttcatgaacaatgacaattcatttcagcctagaggcaaagagggtgccttttcttacgagacttttgttcttattgcctggtgaatttttaaatcaaattggtggaaaattggaatgttttcctctcttttgtccttttgcatctccatacctccctccctcccagtatttttgagaccagatagaagcaga

SEQ ID NO: 138308 - DNA, 1049 bp, Homo sapiens
cccaaagactctccagtgcctagaacagtgtttggcaaatatttatagtagttgctcaatatttgttgtattagtgattagcctgcatgagctatctggcttgcccatttcaagtgctgtgatgaatattctatgccggagaaatcatcctccagactggatcgttaccattatcttcatttggcattttattaccaacaagatagtaccccaggtaccatagtaaaaatgacttaagtgctttccatgtccatgtgcctttatattttacttaacaacatatattcttcacattgacatacattcattcagtaaatatttgttgaaaacttacaatgagtcagacacttacttgcccagaaatagaggcatagataagatattgcacctttactgtaactctactagaacacaaccctagaaaaaattcagaatctgtcatctccatagttgtggatttctctacaaagttgaaatttattgttgtttttgtgacaacaacatacgtttcctgatttttctgataccttttgattcatcctcatcattgatgtttctttttctccttgtacattaaatgcttttgttcaccaaggttcaaccctcacactctacacaagaatctttctgtgtgatttcacccactctcatatttttaactgtctatatgcaaatcatttctaactccgtagctatagcctacagttcttcctggaacttaaggcttgcataatgaaatgcctgctggacaattctacctagatgttcaataggcaccttcagttcatgtcaaaatcttaactctgctttttcttctaaaatctattccgtttttgattctttgtaggcggcaccaccatccagctactcactctagcagggaactgggtgtgaaccttgattcttccttctctataaatctccacatctcacaatctctgtatcctgcccgttttccttcctaaatatttcttgaatgtgtcacctctgtggcttcctaactaccattgtcctattcccatgttttaccaactgttgctgagacaact

SEQ ID NO: 138309 - DNA, 1581 bp, Homo sapiens
aatacaatattcttttactttagatatcaaccttataatttattaggagaaataaaaacacaaaagggcagtaatataccagcccacatgtagtctcatattccagtacagttttatctgactttgcctttttgatactgatgacacagggagcatctggggctagataaactgctcatgctctgaactatatgttgaatattttgatagaaactctttttgcctgtggcttatttgtcatatgccgcttgagtgtgaacttaatttgcatgactgcaataaatgaaaagtgtttcttatttcctactttgagtacataaatttgaccttgatcaatgtcagcaaaccaggcctctggcaaccacttcacaattttgactatccagagaagttcatcatcatctttagacaactttaccctggaatggcaggtttagttagtatcagtggagtcttgtcagacgtgtttcctaacaaaaatgacctcaagcaggagtgtgtggttttctctgagaaagcttttcttcccctgagcagatcatagcctccacaaatgtctttgaaacaggcatgcaaagattgctctatacagaagattgtgacaccgaacatgaggttgcttcgaatggttatcctaaagtgacctgccaaactgaagggcaaaaatgccactgctcttgaagtcttaaaatagtatctcttcttgttgaatccatgggaatagaaaaaagaaattgtggtcaggccatatgagaaggaatgccaaaaaaaaaaaaaaaagtcaccaaatccatttagcacttggtaacaaaaggtaagaatagacattgaatactgtactatttttagtatccattccagcatagtgctaagtatgtcttgcctccaaagtgtgttactccttctaccttctccatctctaacagtaataagcccagtcacctaagttcaaactctgagtcaactttgactcaagcttctcattgattccctagaaccattggttaccaatttagatttcattatctcttgaaactgttgtacctccaagtactctaaaattctcttatttgaacatgtccacttccttccacctttcctagtccacacccactctgcttctgcttttccgtttggtattctacaagcctttttcccattcaacttttccatctatctcatttctgtccctacccaactatgactctgctgtccaacatgtcagtacgtactcaaaagcactcctcattcattctctacccaattctcagctgctcctagccccaaccctgcaaataaccattgtccattttctcctctactgttcccggactaattaatgctggtaggcaacgacatataatagtagcatgttgatcaggcccactgcaagcgaaagaaaaattctaaattcattagttagaattttgaaaacaaaacatctgtcctaatacatctacttggttctgaaaaactgtgattactgtagttattgagaggtttctgtaacccaaatacttaactgggtcgtacatgaaaattatttttaagattaaaagtagagcatatattgtactgaca

SEQ ID NO: 138310 - DNA, 1061 bp, Homo sapiens
gaatccagaaagcattttcctaccaaggcagtgttataaatggtggttgggctcccctaggatagccaataatgttactgaaatactatacatttgcagtgaaacagtagtgaacacatttatcatatactactaattaaacaaaagcaataacgttgaataagatcattttatattttgggcttcaatggtggtgcttgaggaaaaacaggtttaattataagaggatgaaaaagtagatggagactgtgtgaaatctcaaaatagggctcatgagcatttttgaagacttcaaatgacacgtgttctttatcaagtctaactgattttaaaacttgtgaacttttacttccctttttgtggttctaagtgttttgtagtacaactgttgtgctatgattctggtcagtttttgactagtgatgaaaataaaacaagggaagaggataaaggaagaggatatggtgccagaggaaaattttgagaagagggggcttatatgcaaatatgaggattaaaaaaacaactttatactttagcaccacaagcattccacaagcaccagcaaccaaaggaaaaggagttctttcttgcttagttcttaggccatcctatataaatgtcctaaatagagataaaagttgcaataagttaaagaggctaagttgagccacactataaggagatgatatgtaaaccgcaaagcttgcatgagctgaggtaggaagagagttatttatttgcttttgttgttgttatttgtttttttgtcttcagttgtgtcttaatctgtttagtgttgctataaaggaatacctgaggctgggtaatttataacgaaaggagatttatttggtttacggttctgcagactgcacaggaagcacagtgccagcgtctgcttctggtgagggctttaggttaattccatttatggcagaaggagaaggggagctggcatgtgcagagaccaaatgacaagaaagagagagggaagggagcttacaggtttttgtttttgtttttaaacaaccagctttctcaggaactaatggagcaag

SEQ ID NO: 138311 - DNA, 1023 bp, Homo sapiens
cccgctctgtttaatctgtaattagtcaaatttaatcttagtggataaggtatctgaattgggttcccaaaactcatctttatttctatttttttttttacattttgcaataattatgaatattttgaatatttttgaattttgaacataaaagttgcaagaatagtacttggaaatccctgtataccctttgtgcagattcaccattttaaacatttagccacattcattttgttatgcctcttaaatttttaatacttcaattactgtttcctaagagcaagattattcttgtaggtaacaatagcaaagttaccaaattcaggaaatgtatcattaatgtaatacttccatctaatcaaccatccatgttccaatgatgttaactgtctcagtgataccttttatagcattttctcctccaatgcaagatccagtccagaatcacacattgcatcgagttgttatgtcttcttagtctcctttaatgtggaacagttcctcataccattgcatacactgttaaatatgaagaaaactggtcagttattttatagaagattcctcaatttgtatttacctcatgattagattcaggttatgtacttctgtcctaactactagataagcaaagtatgtccttatggttcacatctggaggcacaaaatgtctctctgtccctcactggtaatgttaacttcgatcatctggtcaatgtgttgcctgataccttcattttataggtattattttctctgtttcaactaataagcaatctgtggaaagacactttacgaccatgtaaatatattgctctacatcaaactccccctctagccttaactactattgatgattcattcctgaaccaatctttaccacaacagttgcatgtcatcttgtattaatttcttttggaatgagaagaaaaacaataatttactctggtaattttctgaagaataccgttgatttcctttgacaatgttctaataaaggaaattgctctctatggaatcgta

SEQ ID NO: 138312 - DNA, 1048 bp, Homo sapiens
ttctccttgtttatctcccattgcaccttaattcctctttgggctagagttgtctctgtatcttgtctccaccatccaccaaattttaagacctgaaagtagagacatcattttgttctatctcctaacatactttgcagttaataagaggcaaaataactgtttagttgaattaaaaatgaatgtgaggaaatattgtggccatctgctaaaatgcataggtaacaatgttggaaaagaagtggctcttttttaagtttgatgaaaaaaaaaaaatatatatatatatatatatatatatattcttaaaaaattaatcacttgtccaagatttaacagctaaactaacatttactgtatgttcattattctgcataatatgtttctcatatatgtaaaagcacattatttagtcaaaactatcatattaaatttctcccgtaattcctaagggctgtcagctgctcattaaatcttgattttctgtcaggaggaattaataatcttgcctttgagtgaatttagaagcaatgagggattgagcaggaatatttgaataccctctcggtggtaaattggatatccaattttcaacttagtcttaatgggaaaaaaagaataaattgaattcagaagctgttctttactttttaatatttcctccccacttttaactgagttaaaatggaagggtatagttctttctcagtggtggggaaaatcaactttcattcacttagaaaagtttgtcaaattcgaatgagacttaatatatggacaatctatatgactaagtctataaggtgatcctttggaaatcataggaaaattcagtacaataacacaaaaattgatttgcatgaggtttaaatcgtgtttttctaaaagcaaggaatcctgctcctccctctccccaaatgaattttgttgtcaaatactggtactaacaattattgatatcacaactcagtctctaaaagcaaactgtcctattattaccagagaggtgctaactcacattaacctaataatatatagctcttaattt

SEQ ID NO: 138313 - DNA, 1031 bp, Homo sapiens
tgataaaactgtatagttacctggtaaactactgtttataaactactttaattttacaatatcttatttgaaccttacaagaaatgtgtgaacatagtaaggtagggttactctcctcattttgcaggtgaggagactgagaattagaaaggacatgtgatggccgggcgcggtggctcatgcctgtaatcccagcactttggtaggcggaggcaggcggatcacctgaggtcaggagttcaagaccagcctggccaatatggtgaaaccccatctctactaaaaatacaaaaaaaaaaaaaaattagctgggcatggtggcgtgcgcctgtagtcccagctactcgggaggctgaggcagaagaatcacttgaacctgggaggcggaggttgcagtgaaccgagatcgcgccactgcattccagctgagtcaagatcccgccactgcactccagcctgggtgacagagcaagactccctctcaaaaaaaaaattaagaaaggccatgtgacttactcctaatttcctggcttgcatgaggctgagccagaatttgagcctaaagcttctctgagtccaaatttggtgttctctccactatatcgtgctgcttctacttatgggattgggaaatattcgggaattttaattgacaaaagtgaactgtgttcaggacagaacttaaaactaaggtagatattaagggaacaccctatagttcaatgggtgtttttctaggctatagatgaggagaatgccaaggttattacctactccaacaccaccactttgtggtacaaattaacaaagataccccccaaatctatgtatggttggcttgcacaaattaactttgtatttggcaaaaataaaaagccctcaggataatatttcccttatgtagtaaaatagctataatagaatttcacaatctttgttattttctgttgaaatgtccacaggaaaattagaattctgctaattgattttttttctgtatttataataagccctcatacaattgaagcata

SEQ ID NO: 138314 - DNA, 1082 bp, Homo sapiens
gacagaaatttattgcttacatttctagaggctgggaagtccaggatcaaggtgctgtcagatttaatgtctgatgagtgtttgctctctgcttccaagatgacacttcttgctgtatcctcacattgtgaaatggacaaacgctgtgttctcgcatagcagaaggagtagaagggccagggagctctctaaggcctcttttgtaagggcattaatcccattcatgaggatagaacccttatgacttaatcacttctccaaaggtcccacctcttaatacagctacagtaagaattaagtttcaacataaattttagaggactacaaacactcaaaccatagtaaagggtatctttgaagcattgcagaaacaaatggggaaagggaagtaccatacatgactcacagaacaacttatcctggaagttctaaagaaatagcatgtttaaaaagtgaagtgattcaggtcaactcatgcactatagatacatggttgctttgtaagagaaaccaaggaggaaaagccatcctttctacaaagcatcccttggtgactcccaccaaaaatagaatcacaaggctaaattgatcatgaatttggtattcttcatggctttagttttaaaaatatttttaaagtattaaaaggattagtattgaagatagtaatactggtaatggtttgcaaagcttcttgttcttgtcctactttggactccacctgcatttacacaaagtaccttcctgtcaaagtcatggacctagaaatccaggcttagtgcttgtggatgccatctggtatgggggtcagcttacggactttgaaactccacagatgtccaccacttattaactacatgatcttatgcaagctttttaatttcttggaggcttactcttctcatttgtaaaatggttttataatacctatcatacgggatccttttaagaatgattgacgcaatatatgcaagtcacttaacacagtgcatggtatccactaaatgctaagtaaacagcagctcttactattgttgtgagctaagtgagctatttatacaaccctggattcaaaaagttgt

SEQ ID NO: 138315 - DNA, 1049 bp, Homo sapiens
ctcagcagccgttacatatcattagtgaagggaggcaaggggcaagggggaccattttgatgtcagtttcattctttttaaagacaaatgcattcactgatgagaagtaaaccagcatctgtaaaattttacagacaagtaatattttaatgccttcttttcctgtagataaacgtataacttttcaataatcattaatataaactgaaataatgagtaattgtgttaaatacccataatgttggagctgcttttaaggaaaccagttatgaagcaactgtaacatcaagatcagtatatttctgttccaaaatagtctgtttcatagactcagtacatagcttgctgttatgccacttcggccacagttaatgccaaaatctaaaattttaaaggtgataatgctttttaataagaaatataatttggccttaactttccccttataaaaggccatattccatacacatcaactcaaaagtttgtcccattttctgacttttctttttctttatttgccaaagaatctctgtaattggcttgctctgcaaagcattttatttgcccttctgaacattaactattttaaagatccgagtgtattatggcagggaacacaagattttacttcaaccccttctatgccctcctctctactaaattaattatttctgttttgagtgttccagggaaagagtaaaattgttaaggtataacaggtaccaacgagtcatccaaacagaagtgccattccaggaaagtacagtatctgtgtgcccagcatggatcttggccctgccctacttttaagcttctaacatatcttcgtagtcatttcttctgtattgtgatttttttttaagtgagcacttttagatgtcccatatggtttaaaccaaatcagaaattcatgtccttaatgtttcgttagtcagaataattaagttgatagttcggggagcagttgaagcaaaataatggggtcattgaagcagtcaagctctaatgggaacctgagctcattcagataccaaatctaataattgttc

SEQ ID NO: 138316 - DNA, 1029 bp, Homo sapiens
tatattacaggtaccaaaaaaaaaaagatttaaattgcagttgctgcctttccagagctcacgataaaatgggggaagatagatcgcacagggacaatcacagtataaagctcaagctgaatcttaacagatgagtaggagtttcttgggtaggaaaagaaaaaggaagagaagcatgatccaagaaagggaacagcatttatggaggcaataggagaacacagtatattcaaggaagagccaactgttaacattgctggaacataggtatgagaggctggaaagatgaatagtcatgataggccatgtataattagttcgattattttactacatgggtgataaggagccatttcaggcttagacttatggtagcatggctagatatacattgtagaatgattatcttctaacgatatagaaggctgatagggtaagggtgaggctagagacaggagaaattcaatagggatctattataagagcctaagcaacagaagcataaggcctgcactagagcagtgacagtggagataatgcagaataaatagatgcaaaaatgattcaggggttagaattgactgaacttattgagcaactggatatgaggataaaaaagggaaggattctcggatgatttattgatttattttatgattgctatatgatagctgtagtaattttattagggctgctgtgacaaagcaccacaaactgagtggcttaagccacagaaatgtattgtctcatagttctagaggctacaaatccaagatcaatgaatgggttggctgtgccacgctccctgtgaaggtgttagggaaggatatggcccaggcctctctcctagctcctggtggttttctggcaatctttggcattctttggctggtagaagcatcacgttgatctctgctttcattttcacatggcatcctctcttggtgtgtgtttgtctccaaatgtttcctttttctagggacactagtcataagggattagagcccaccccaatgacttcattttaac

SEQ ID NO: 138317 - DNA, 1006 bp, Homo sapiens
aattgaaagctgaattgtgtgaaacaagctaagtttgtgctattggagtcgagaggagagaaagatcagcgaaggctagagggatcgggaaggtgggatttgagttgggctttgaaggataagtagtcttgaatggaggggaaggagaaggcaaagtgggtacataagcacaaatctggaagatatatagatgtgtttgtggaacagttgtgaagccaacctaactagattcaagggggaatagtagagaatgggagaaaatctgattggatagagtgggatctgtgtaaaaacaaacaatttttaaaaacccagaaaatatgtactccatgaatctctcctgtacttttttagctgccacaaattttggggccaaatttattacacatgtattctaatctgccgaagctacatcctttagtgtgaatctgttcacttttatcttcatatgtcttctcttgcagtgaattttaatctgagtccctgaaagttaacttgttaccatttttattgttgtttttgtcttttcttcaccacttcaaattaggattgaaccagattagtcttgttttaaatccactgcagccttttgagctggggagtacggtctctttgagaaaactgttttctttctttttttttttttttttagaactaagcatttgttgcagtttattggcactgcatatttttatttttatttatttttatttatttttattattatactttaagttttagggtacatgtgcacattgtgcaggttagttacatacgtatacatgtgccgtgctggtgtgctgcacccactaactcgtcatctagcattaggtatatctcccaatgctatccctccccgctccccccaccccacaacagtccccagagtgtgatgttccccttcctgtgtccatgtcatctcattgttcaattcccacctatgagtgagaatatgcggtgtttggttttttgctcttgcgatagtttactgagaatgatggtttcc

SEQ ID NO: 138318 - DNA, 1156 bp, Homo sapiens
acaatgctgcaaagaacatcagtgtatgatgatctagctttatacatttatccgataatgtgaggactggctttgtcccaatagatgtaaatgtcaggaatgattctttgagacatcttatatgagaagcaagttgctaggttagtagccatttttattcatgtataggctcagcctggcactcaggttgtgcatggattgtgttagacactagaaatataaaggaacttgtgccaattatgaatatggaatcaagaagctgtgttttaactgtgtcctaattgttcatatttaaaacaacttttgactggcttctaccttaagggacaatttgtattttaaaacaatggcaccgacagctgttaaagtgtgtgtgatattaaccatacaggttgcctttgttcatacaactggttaagtaattaagcacaggctagcatggggaacattgctaatgggaagcacctgtttatagactcttgcattgtaagctgtaggttaagtatcttttatcaaaatcataggcagtggtatatttctgtgatctggttctttgggaaatggagacatcatgcagggtgaatgaacgactgccatttctgcctcactgctgaaactagcgagcctgcatatcaagggtacctgggcttacttaagctggggagttggactgactaccctaaaacttccatcatcagcaagaaatacgtagcccagacccaagagatgggttgcacatgttaaaaacaaaaagagtagatacatggtcttagagtgattcagaaacaaaggcagatgacaggtaagtgtattctaagtcagcatatcagcaacaaagttcaggcagatcacaaacaactgcctcagaaaatgacagaggattgtccatcatgtgctcaaagttagagaaatggctgatgcctactattcttagtcataggcatatatgccacacatggagtagaaaggcacagagatgacaggtgatagtaatgaattgaccttgtagccaccatgccgtttaacagctagtttattctccaccaacccaaatggctgcttgagctctcaccctgccaaacactcctggcccaggttattgcaatctatgccttcatcggcttttctactgtcactcttgatactatctaggata

SEQ ID NO: 138319 - DNA, 3616 bp, Homo sapiens
ccaaggggactgtgcttgagagactgcttccatttcttttatcactctgacttcgcttaccaagaaaagtcatttattgctgattgcagaactcttgaactcagccgggcagctgccgcatgaactcctcagatctgagttccttgttacttatttacattttcatttgaagtgatttttcaggactatttgaaaacctttctcaacctaacatcatgtaatagcaaagatctaaaacttaccatgcttttggtcctttttctgtttgtcttacagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgtagaaaatactgtttctactcattcaaagcacattgtagatattcagagagaagaacaaatggctggcttggcaaatccccatctgagataaagtaaacaagtgaccagcagcccacagatgattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttaagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccatcatctcctttggctgctgtaacaaattaccaccaataatatgatggcttaacacaacagaaacttatttgcttacatttttgaagggcagcaaagccatgctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaattcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttatatttcaaggcctggcagtaatc

SEQ ID NO: 138320 - DNA, 1813 bp, Homo sapiens
ctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacagccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaatgttgtgctgcctatgataattaagattaaagacaagtgaaaaggcatgaactatcgggggggagaagcttcaaccaaacagaagtgcaggagtgcttttgtatgtgcctggtccagtggagatcatgggatcatattaaaaacatacttgtaggaatcataaggttttctttagcactgcttgccagagtagtggagatatggtacaactgaaaagtttagaaacatcagaagggtgatttacacgctccagagaaactgtttcaacagagaagtttttcgttttgttttgttttttgttctgttttggtattgagtatagaattaagcaagtgggcttcaaatgcttagaagggtaaaaatctggaatgagtaataaaaggactgtagattattattttctggagagccttcaatagaatagctcatcatgggtggggtga

SEQ ID NO: 138321 - DNA, 1009 bp, Homo sapiens
cattatacacacatgcactttgctctgactgttatggcctcactgcccagcctcaccctttttctcctatcaatccttcaaggaccaatgctgcctttctgaagcctttcttaatttttcttcccccactaaaataaattgtgttatctatgctcccacagcaatttgttcatacctctattctggcctttgtttcattctgccttctactacagttgtctgtgtccttgactaaagtgtaagttccttgatggcagtgacggtctcattcatctctgggcctttacacaaagcaattgctcaatgaattaatgtgtagtgtcaactctcagggaattaaacaaatgaaaaggaatgtttgctacaggtaatggaaaatcatagctaatttcctcatccaggtgagaacatagccttcatcactgtcctgggaactgaggacctgcctaaggtcagcattaaggacaaactccccgaactgtgtttagctggaagttgactttagaggagtactttcaggaggtgaggaaggattgaagacaagtaggaagtttttttcctccaaggtcaagcttttaacaagtgcctgcaatgtacactgagggatttggctgtactccaattatgctaatatgttttatatatgggcctccagcatccaggaaccacctccctcaacaatttaataagtgtaaatatcaaggcagagttgtaaatgtggaacttatttgtaatgtaccaaccttgttattatcaaatgtcacagggtataagtcatggcaattatgctgcctgctttttattacatttattttactttttaaaagtgcagtatatcctcataagcttctcctattctgccctacccaaggaacctagtgtgcctgtgtgttctggagtcacagaaggcagaaaatttagagtcacaggattaatgggcatccctagtaagaaagcgacctcgtgaatcattgactccacgcactgacaccatacctctacattaggc

SEQ ID NO: 138322 - DNA, 1017 bp, Homo sapiens
ggcaagctcccactcgaattagcacctgtggaaatgctgcctttcaaagacccagcttcatagcctccaagaagtcttcccagattctctcaactgaaagtcatctttcccatttccatgctataccatacacattattttagtatattaatacattttcaaatgttttgagtagataacacattcatttgtctcaaactcagagagggtaccgaaggatatgcatacaacattcccagcccgtcccccttcctagccaaactaattcctttccttagaggccaccaatgtcatttgatttttgtatgattttgcagataaatcttacatacatatacacatgtatgtaaacacacatttcttccatctctttttcaacaaatggcggcaaagtaaacgtgctgttctgtaccttacattttttgcatttactagtttaccgtagtgaccattccacatggaacgtacagtacatgaaatgtttcattgaactttccactgcgcattaaagatcattgtatttgtgtctgtctccctgacaagccttttaatttttgaagggtatacattttgtcttcttttccgtatcctcgcaaagctctgcatcctggactctggtgctatacacaatactcaataaatatttattaaattgctcaatcagaatgatcttcttaaaatgctcttttgcatttgacactctcacccccaggaaaataacattaacttctaattgcccacagcatactttctttctttcttactttcttttttttttttttttttttttgagacagagtctcactctgtcacccaggctggagtgcagtggcgccagcccagctcactgcaacctccgcctcctcggttcaagcaattctccttgcctcagcctcccgagtagctagaattacaggtatgcgccaccacgcccggctaatttttttgtatttttagtagagacagggttttgctatgttgaccaggctggtctcaaactcctgacaccttcacagt

SEQ ID NO: 138323 - DNA, 1005 bp, Homo sapiens
tcacttttagagaaactacattcttcatctttggcccttcgtgaactctgctccaccagtgatttcaatctcaaagtttcctgaagggctttggccagatgtgaccaacagctcatcatgagctgatatctggtatacggcctcaaacaataggaagaagatgatcattgtattcatgcaacatttatataggtgtctctctccagattctggcaagaaattgcaaaaaaatgaactattgcttttgaattggaaacaaagtacttggctgctaaaaatgtggcactgcagcccacttacaacagttgagggcattacaacagttggactctcttggtgtcattcctttaaagaaaagcattatcagcaagaagcaaatatgggtcattcttattaatatttccatactctaacttccttctgaggggcttggtgcattctaactcaattatctcacttatctttgagggcttttgattatcttgggtggggttgtgggacagggagggtcgacacacaagcacatatcctttaagagctcacagatgcttttacatctagcaacttgtttgagcctcgtaagtctatgaggtctacagagatgatcataccttatttgtgaaagaaccatgtttgaaagccagggcttccagcactacatcccaaataccccgagagctgtggctctcagcaccactgttgctgtagacagcattcactgttctttaacttccaaggatgtcagggtagccgtgcgcttgcaaagagggggcaccagggcttttttcttcccctgcttcatttgctctttatttcttacactctgactccttattgaaggtttgtggccctaaatgcagtttctttagctgtctctttccctccaaccccaggtagtattttagcctggatagttcccataggtatttctttatacctaaattcaaaagtgtttcttgacttccttaaacctatgcccttttatgatcaacatcttgcatgtcc

SEQ ID NO: 138324 - DNA, 1054 bp, Homo sapiens
aacaaacaaaaacagaacactaggtagactagctgttagcaatctgagaaatagaaaatgttttctatacaaccatcattgttaattgatacagtccaatgcccaataacttacccatttatgagatgtttatcaacaagctactatgaaagatacaaaaactgtaaaattattttttaagatgcatcctgagcaattcacattttgttaagggttttttaaaagcaaacaaaccaatctaccaggttatgagcatcatcttttaaaaaggcgctttcagcattgtcttatttgaaaagacaggcataaaacagtatctgattgtgctggagactgtggaaaacactgaataaggggataaatttgagcagaaataatgtttgagcctttgaagcaaaggcaacgttgaaagaaagaggtagtgcattgtacaactttgaatcccacatcttcatcctcttagcagatgccttgattccttgttttgttaaataaaagtaagctctcccttgtctctgaaatttctcaatgtcacccattcaattgtccttcttacctacttcaatgcaagaaagaagcccatctcattcaattccactctttccagaactatggaaatttgtctacttccatttcacgcccacatttcctacatcttcaatctcttccctgcactagcttattctgcttagcttttaagcatgatcaagtcttctcatatgctaaaaaacaataaaacaccaaaattccctatcttaattctgtgacttcttttaaggtgcttattcttaagctagaacttactgagctctcactatgttccaagcaactgttcctaactcaaactctttacatgagttatttcattttatcctcacatcaaccttacgaggtaagtaatattattcccaattgacagagcaaactgaggcttctgagcttaagcaacttacccaaaatcatgcaagtatttagtggtggagttggaatttgaatccataactaactccaaattctaagctcttaagctcttaaacactgcactgggatacat

SEQ ID NO: 138325 - DNA, 1050 bp, Homo sapiens
gaagctgcaatgagctatgattgcactattgcactccagcttgggcaagagtgagatcttgtctctaaagaagtttttttttaatttttttattatttatttatcatttttttgtaaaggctctgtcatcctagatgtataactgcatgtagaatgcatctgacttttaaatctacaccaagtcaaataactgatttgaactcttcagagaagtgacaagatgttgtaggtatcccactaatataggtttgagggacttaattctgtgggcgtctttatatgaaactttcaaaaacggtcctatgtttttcagagttgtagtatctcagtgttctatcttttggggaatagctcattggccttctgtgtcacctcatatttactagtaaagttgctttttcaaatggtttataagcacctagatgaagtccagcactttgtcagattattttctccatcacagaagccaaaatacaaagatttcagtctagtcaatctctgcttatctcagtcactgtcagcacctcttatttcttagtctcaattttccaggcagccttttgcttgatttccttgctccccatgcatcagcacaaatgatttatacttatgtacatcttgaaatctcttctttatggattgaattgaatcgagccccagtacaaaaatgaaaactccaggaactgttgtgattgcccaaattacaacttggattgtatgactgtacacgccacactctcatctatcataaatattaaattctcaagcacttatacttcaatatgttttaactttgtctgtttgaccagctcagcactaaagattccattgaagataattcaattgctttgaattctgaaaggggcatctttttaatctattttcatgttgcactgggagttaagtgaatttcaggtgcatagcctgtgaatgatgggagaggcctatgtgccatttggcatcacagaggccaaatattgggtgacatttgctaactaatgctgatcagtgaaatggtctaggacaagattggggttcatcagtcttttc

SEQ ID NO: 138326 - DNA, 1111 bp, Homo sapiens
ctgggattcttccatgggctgaatgaaacaaaatattgcttcaattatttagaaaagccgtttaaaatctcagttctgatcctgtctctgactcacaaagccagatgcttttccttggttaacaaaattacacagttttggtgtgtacagctggtcatggccaagacagtgtgtactagacatagtgaggttgtgtgtatttctaatattcagtccctcctggagagttcaactggcaaacccattcagaaaggagagaggcccacttacagctgaatacagaccaggccatttaacctgaatcagtcacaatgccctgcgtagggaaaatgacacttcttttcttttataccaaaggccactggactcggtggaatacttaggtccaatgaaatctatagaagagcagggatgattgatttgttcattcaactgatatttgttgagcctactctttgtaaggcactgctctaggctctggcgttagagagatgaaaaagacaagaaatgcacattctaaagtgtgagacaatcaagtaaataggtgatttgcaatatagagtaataaatgctaatatagggtgcaatgggacattctccattgctaggataataacattttgatatatttcctacattatctttatattttcctaattaattaattaatccattcaagaaagcaacatttattaagcaattatagcatagaatgataagtgctatgatgtggcaaatataagattctatagaaatttctctatattatgttacttacattgttctttatattatttcattaaaccattctttcatttgttcattaatttatcccattagcagttattatacatttagaatgtgccagataatgtactacttcccggggatcaaaaataataaaacacttgtttcttgaacccagggagcttacagaaatacagacaagtaaacaggtaatttcaattcagaataacatcctattcctgagcacgttacattcttactctccaggttgggacaaaagggtactacatagtaggttcctctgttgggttacctgtgtcaaacccagtccctttatgagctgtagatccagttacagggctta

SEQ ID NO: 138327 - DNA, 1115 bp, Homo sapiens
gcatttttacactgtgtggaggaacatatgctaaaggcagtgagacttatgtactcctttccaagtaacacactcagtctatgtggcaccccactaataggctttaagcggccagcattgcaggaggatgtgccattgccaaaagcccatcaccagctccaggagaatacttggcactcctgcatcatctcttttgttaacttgtaaacagccctgagctgttaactaaactaaactgtagtagcaacatgaaaaggagatggaggtaaatagccaggaggatattaggttaaatacatacctcatcaccagcaatgcttcttcctgtcttttgagcaacattgcctttaatctggtggaatgattggttcaaggataaactgatttgaggaataaattcaagatgaaacattctagattgtagtccttgaggtagctgatcccaaaaaatctcacacgcagctgaagctcaaatttcagtgattagtttaataaacattgggaagtgtaaacatttgggaataaagaactaggctaaaaagtgtgtgtcatatttttattggaataaaacaacattatgattgcactgaaggaaaacttttcaaacaaaggaacaaaaaatcatccacaagctctctaacacaggagctattttcacttttagatttccttttctagtctgcatgcaaatacatacacttttttttacatagttgcaactgaaataaacatagactttacagttgggcttttttcttatagcatcatatcataaacactgtcaatgtctccacataatcttaatagtctttttcaaggtttcatttgatgttttgtaattataaaatcaatattattataattttttttttttgaaactgagtctcgctctgtcgcccaggctggagtgcagtgacgcgatctcagctcactgcaagctctgcctcccgggttcatgccattctcctgcctctgcctcccaagtagctgggactacaggcgcctgccaccacgcctggctaattttttgtgttttcagtagagacagggtttcaccgtgttagccaggatggtcttgatctcctgacctcgtgatccccccgcctcggcctccc

SEQ ID NO: 138328 - DNA, 1026 bp, Homo sapiens
ctgaagttattctacaaacaatgggaattaattgaaaagttctaagtagaattccttttatgtttattaaaatctctctggctgctgtgagaagaatgaattgtaagggggcaagagttttaaaaggttgaccagttaggaggtaactgaaagagattatagtggcttggactaggaagtggtagcagagatggaaataagtaaacagatctgggacatattttaggtaaagcatatacttggtgatagattgaatatatagagaatgagagaaagggaagaacaaaaaataacatagattctggtttgtgcctttgggtggacagtggcaccattcactgggattaggaagcactgaggaggaccagtctggggtaagtgatgagcatagttttggacatgttaaacttgaacagtctatgaagtatccaacaggagttgtctagttggcagctgggcaaatgtgtctggagcttggaaaacaggtgcttgaatggaaatatagatatgggggccatttgcctttggatggcattcaaacctatgggagtctatgatatggtctaggaagagagttcaggacaaaaggagaaaagagctcaagactgagccccagggaatcttcacagttatttattttgagacatgctttcacaatggctttcattttataaaaaagatacacactcattataaaaataatggagaaatataaaaatacaaaaaagagaaaaaatcccttcaaatctgcaccaaccaagaatagccattattgtgcctcaattttcttatctgaaaaacaggaggatacaaacagtacctataggttgttgtgataacttaatgaggtaatccatttaaagtgcttattttgcctggcatggagtcttatgcccgtaatcccaacactttggaaggctgaggtgggaggattgctcgaacctaggagttcgagaccagcccgcgtaacacagggggacctctgtctctacaaacttttaaaattagccaggcatggtggcatgt

SEQ ID NO: 138329 - DNA, 1268 bp, Homo sapiens
agatcataagtggtcccttttttaacatgttttggcctggagagaggagaaacaaagaatcccaagaatgaccttattcgtgaggttccctggcaggtgcactctgctcctcaccaatattgacattttccttagtccttttcgtagttttcatttaccacaatcttaatcagttgttgagagtgtggctttcttggtaaaaagatgtttttggtgggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaatt

SEQ ID NO: 138330 - DNA, 1048 bp, Homo sapiens
tttcccatgtattttcttaggtcgcttttaacctcttcattcttttccttctctctagggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtg

SEQ ID NO: 138331 - DNA, 2120 bp, Homo sapiens
gccacctggtgtcctgagatggcttgtaagtgaatgaatgaatgaactattaagatctcctcagaggaattttaaaaaggatcgaaacgattctgaattatctttttggctgaaataagttgtttttaaaaatacgtgtgattattttagagtaccatttgaaagggacatgacaaagtagttcagaatactttttaaacatctttcactacattcatcgtcattctcccttaaatgttgtatgtgtggaaatacataggaacctgttttaaaaattatattaaataacattgatattttttgtagtcactgatgagacttgcagatctttaggtaaataccagtgccaaagtatttatttgcaccaaagttaaggaaaatctaacacgtgtcagatcagtctgagaactaacatttgagagtacctacacattttgtatttagtttcagtggtatatttcctttgttaagaggtctgaagaaatacaatggaattgggattggagaacactattttgagtcttatatttgatgatataagtttactttctcactaaagatctatgttataaactcagaattttaatgttacctattttcttccttagtggggaacattccttatgaagctactgaagagcagttgaaggacatcttttctgaggttggacctgttgttagtttcaggtgagatccccttttccttcatggtgggagcttcttaaaaatcaccacagatttggctcttagtaataatggcaggttttctttactggtgacttttcacatacattttgttcttgtaacagctttattgagatataattgatacactatacaattgacatttattcttacctaaaatatgtttttttcgttaaaaatgttttttaggcagggcatagtgactcaagcctgtaatcccagcactttgggaggccgaggcaggcggatcacctggggtcaggagttcgagaccagcctgaccaatgtggtgaaaccttgtctctactaaaaatacaaaaattagccgccgtggtggcccatgcctgtagtcccagctactcaggaggctgagacaggagaattgcttgaacccgggaggcagagatagcagtgagccaagatcatgccactgcactccagcctgggcaacagagcaagactccatctcaggaaaaaaaaaaaaaaagttttaaaaaatatttctgtgaggctgtcagagatataaggttatttatgttacagtgggcccaattaaagcatggcaatgttagcaggaaccctgtatgtgtgtaacatttgttcctgacacttggttctgctctccagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagtgagtacaaatccaacttggatgcagtatgagttagtaaagatgtaacaatgaagattttccatttctgatatgttttagaatatgctgaaatggttagccacgcagcttgtttattacttgactgacctgatgtgcctgagttaggcaagtattatatatatctttttaaaaactttttataaattttttttcaagtaattgtctgaaatttctatacccttgctctggatggagcagggcaaggcctcaaaccgtttcaaaactgttctggcaagcactgtagggatgcatagggtcactgcagacctaagcatgctggaggcttgctagtaagtgtatatctttaagaaacagataaagttgacattagaaattcttcagttgctccagcctgggcgacagagtgagactctgtctcaaaaaaaaaaaaaaaaaaaagaatttccattgctaaggagttatttccagttaaagatgaattcaaattcatcaagccattagtagtactaactgtggcattagtcattcctgtcactcttttcaggaatttttgaagttagcgtatttttctcttttaaccttttgtttctgaaatgacttgttaaaagaagtcaa

SEQ ID NO: 138332 - DNA, 1979 bp, Homo sapiens
gaaggtgggaggaggcattaggttatgaataaagcaaatcacatcaggttttcaaggagttacttgaattagttccctgagctcaaatagaaattgtctgtagaccaccatttcttgcaccttcaatattctgtatgtacacagtatattttacattttgtacaaagagctttctatttttgtacacaaacacagctatccaaacaatccagctggagttttgtggcccatagatgtcagatgtagatattaaaatttggcttttttcctaaatgataatatcacagtatttgaaatgcctctttcttctcttgcctgccatgaccaaggtttttttgtgccatgcaaaaactaatgataaagagcctcttgaatattacatttctcagaggggaatggctctaaatcactatcagtttctaagtcataagtattaaacctgaatctgcttatcttctcagctctgtgtccagaatagtccccaggaggcacggaacatgttacttcagaaccctcaactggcttatgctttgctgcaagcacaggtagtgatgagaattgtggatccggaaattgccctggtgagtgcttctggttcttttatggaaatggtcgggtaaaccttgaatgggataggaactacctgattgctttgttaaacagacagctcataggtttgtcttttcactttttagaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttggtagggctttatcccttaacatttttttgtatctgtcttagaatgtcattttctttttaggagaatatattgaaagaagaatggtcaggaaccagagatgataatttcaatttccaggcataaaagcaatttccaggttgcagagcacatgacatctgaatgaatatagattcgattccaagtttgtaaaacaaagagatccttcccgtatgcccttttcttataagctaactttgtgtgtatgtgcatgcctggcactgtggttggcacttcgttattccatatgcattatctcatttaatcctcaaagcaattgtatgaggttggcactcttattatctccattcttactgatgaaaaaagtaaagcttgctttcaaagcatgacacaaaaccttaaagccataaaaaattgatacatttgaaaactaaaaaatttctatataaagaaaaaaataagtatcaaagacatgacaaattgagaaaaagtatttaccacacatgtgatggaaaacagactaataaagagcccatagtcattcacaagaatgtttattgccttagagtgaaaaattggaaatgtcctaaatgtacgtcagtggaagaatggagaaaatgtgtggtacattcatccagtgaaatactgtacaacagttaaataaactacacgtatcaacatgaatgactttgaaaaacataattccatacagcagttaagatgaactaggatacataatatcaacacaactccaaaacagtgacatacggacatgaaactaagtgaatatggatgcattcccgaaatgtaggatatatgtttctgcataaatccccaaaatatgtggaatgagttgcaaaataatatattgagtatgtaatgattcatataaaattttgaaacattaagaagacgtcttagtggtcatcaaaggagaagagagcacaggatgcaattggggaagaccgtacaggccattggtttattttatttacttatttatttcctaagctgggtggctattttattttctatatgatttgtatatctgtaatttttcataataaattttaaaaggcctcctataaattagtaagaaaatttccaataacccagtagaaaaatgggaaatagacataaatatttcac

SEQ ID NO: 138333 - DNA, 1018 bp, Homo sapiens
tttgtgttccttaaacgtatatgtgattttttttatataacttggcttttattctttatttattgagctgtttctaattcaagggactactcagttttttggggaatgcacagatgaaaagatgacattctctttttctcaacgagttttaatgtagcatttaaaaaaatatatttcacattcccccaaaaccagaattatatctaaggacaggagtgagaaaagattggttaaattaaaaaaaaaatttaattttaaaaatgtggactaccagcagttgttttttttaaaagagtcccagtctccttttatgtttcttgggtttagggcttttttttttttttttttttactcttattggcagccccaatcatgaagttaacagtaggtgttatgtgctgccttgccacacagataagacttgtcaatctctacattgagaatatgttccatcttaaccgtgttccatataaccaggctcatgacgtatattgcttctgtggagtttaaagtgtgtgacaaatctaatgctgcataagacatgccatacaaaaaggatgtttagtagtgtatttggggctgttcatttgaagaggacttttaaggtcgtagacttagtatattgagtatccacagaggcatatacatactctgttttttttgcttggtcagggtggaatgcatgtcaatggcgcacctcctctgatgcaagcttctatgcagggtggagttccagcaccagggcaaatgccagctgctgtcacaggacctggccctggttccttagctcctggaggtaagtttcatttagtcttcaccatttcagtacttgctaaagttttgtcatagccactgttgcagtgcagccaaatatgataatgggatccttaggtaaaattaatacacagctagaaagtatatatcttaggtggaggaaatagtagatttcttacgttaaatcctgtatgtctaattataagaacagggaaagggacagtaaagtgaaagagcatagtaa

SEQ ID NO: 138334 - DNA, 4140 bp, Homo sapiens
tctgccctttatcttctaggaggaatgcaggctcaggttggaatgccaggaagtggaccagtgtccatggaacgggggcaaggtaaataaatattaatgtctgactaatgttaattggtcatggaagtgttccacatccacagtatctaatatggcagccactaaccacccatggctatttcaatattaagttaattaaaattaagtaaaatttaaaactcagttcctcagtcacaatagccacattccaagtgctcagtggccacaggtgactagtggataccatacaggacattacagatatagaacatttctatcatcgtaaaaagatctattggacagtgctggtctagactttccacctggtgattcagagtccagctctacaagaattgataatgaagcaagtggatcgtttgtttcctgattcctagtctaataattccactgacatgttctctctccctgtatggatatctgttgactgagtaaggaattttaataatgagcatgtaaatatgtggctgggtatgtagaagactagatttaaaccccagagaaaactgggagggaatcataggtctgtaacgcctacttaatgaacatatgttgtaccgtggctgtactgctatatacaacagtagctgctgctccaaaatctccatgttgtttcttcatgttactggagtttgaaggacaagaaagtgcagtggttcagttggaaacaatgttaggaggagagatcgtaagaaaagagaaggaactgagtgcatactatatgccaggcactttaattttcataaataatcttgtgagttaggtggcagcacctcagttttacaggcaaagagttggaagctcagaataagttactttctcaaggggacaaggtaagtaaatattaatgtatgagtaatgtggactggatttggtgctcttattttctcttccaactagtaagtggcagagctaagattcagaagtctttgactccagaatctgtcctctttctgtcactccacactgcctctgttaacttccaagcatattcttcagtgtcttctactcttattccttgggaataaaatgatgggaaagactgctttggacaagcatagagaagcttaaggttttttcttttgtagcatatggtttataagtggaacccatttaaaaagcaaaatattggccaggcgcagtggctcatgcctgtaatcccagcactttgggaggctgaggtgggtggattgcttgagctcagaggtttgaaactagcctagacaacatggcaaaaccccgtctctataaaaaatacaaaaactagttgggcaatggtggtgtgcacttgtggtcccagctacttgggaggccgaagtggaaggatcacttgagcccaacaggttgagactgcagtgagccataatcgggcaccactgcactccagcctgggcaacagagcaagaccctgtctcaaagaatatatatatatacacacacacacacatatatatacacacatacatacataaacattaatatacaagcctgtggtttttacactggggttggttgctgaagtgacagaattaactttttcttgttagaagtctgacagcaggacaaactccctggccaaatatctcatattttctctaagcatccaatgcttttgtgctattgtacatccctctatccccaccgcaccactgtcaatagatcatatatgttccccagagtatttctgcagtaatgagaaggtattagggtttcagtcatacttctgcctgtcatggggccagccctcaatccatcaggttttagctgtttaacgcatacttgcacaagacatcttcctattatagttatcttcacctttttgtcagaaattggcaaagggaagtgactcatgttttgagggtatttccaggatgtcttcatgcagagactaagtgagatgagctttcttttatagtttccttcagtacccagcagaggaagcaagagtcttttcgtgtgtgcctagtttgtcttacttttcctgaaatccatgctgcttttaatgctgaaaggagatggagatgtttgagaagatacttcttgcttccctgccatgtttgtttagtgtcggttcccatgtcatctcattagtctttgtttgctgttgtcatgatgtttattatcaaagacttgctgtggcagagtatttcttgtggagtgatattctctttcatcatgtaaagttcattcactgcatttccccatctgatacatttttgacagcagaaatttttgtgctttaaaatgtgacaaaaatagaattgccgtacttcagttatggccgtttcagaatgaatcttgccttccagattcagtgcagtttcttttatgttttgcttctgaaactacatttatgttctttgcataactagaagattcaaaactatcctttttatatatttttttcctaatgatttcataaggagacctaacggaaaactagtagcagaggtgaaaatcgaaaatgtcaggttattcccacctagatcaaaccagtgcccccatgggattccctttcaaaagctatctggtcaaaatggaactatttcagagacccaaaggagctagtgtagtttagggagattttgtagcctggagcaagccgatgaactcttggctttttaacttatatatgtaaatctcaatctccatgtgtgtgtgtttctgcgtgtgtatgcaagctattttaagtgtctgctctttctccttttgaacttactgcttacctaggaaccctacagcactcgcccgtgggacccgccgggcctgcatcaattgagcgagttcaaggtacccattgtatctgtgggtttccttttgcttgtggtgttcagggtgggacgttgagaggaaaagagctgcgtggcagtcatcctcgcgttcagaacccaaaagggtagtgtttttgggtttttgtttttttaattttttcctgttgaggccacaagcctaagattgacctcttcacacagggcagagaacatggatgatatgggcatctgtccgaggctgtactccctccctactggtgtcaggaggcttggatggaatagcagtctgtaaggagacagcgggttcttgcagagccatggcagtgttcacatatgccaagactctacctctgttttgtgactctggtccttgaactaagattgattagaaggaaaaccaggagcataagtttctccaggtcgcagtgctagtccttggcaggttgctccccagtttgctctttatataattccatccatacctctgacatggcacagattctgcctacaccctgcttctgttcttgagctgcaagaggattctgctgtggtgaggtttcacccactctaaggtgtctgaattatgttgtcagtggtatatagagtcatttcttgtttgcttatgtgtctttcacagcagtaactccccgtttgtttccctgtcagtgccgatgcaagaccccagagcagctatgcagcggggatccttgcctgcgaatgtcccaacccctcgaggcttgttaggagatgctccgaatgatccacggggaggcactttactttctgtaactggagaggtagagcctaggtaagcactaacatagaaggaaacagttgaagaaatcagaattgtcccttcttccctgagaacaaaatctttctgtaccagttgtacctgtttgcctacttcaaaaggtagatcaatattcatggccactgtccaagggtaagcacttctcctaaggcagaactatgtacttgagtatgtcattttgagctattatatttttagaaattggaaattttagtatacatacttgaacagggaaatttatagtagtggaaatattaataatagcaataataggccgggtgcagtggctgacgcctataatcccagtactttgggaggccaaggtgggtggatcacttgaggtcaggagttcgagacctgcctggcctacatggtgaaatcccatctctactaaaaatagaaaaattagccgggcgtggtggcgggcgcctataattacagctactggggaggctgaggcaggagaatcgcttgaacccaggaggtggaggttgcagt

SEQ ID NO: 138335 - DNA, 1031 bp, Homo sapiens
catgtccctggccatgagagccgaggaccacccccacatgaactgaggggagggccattacccgagcccagacctctaatggcagaaccaagaggacccatgctagatcagaggggtccacccttggatggcagaggtaaggggagatcacattgcaaatgccataatgaactcaactgtcttaggctctaatctgggataaagaatgctggaacagtaggtttgcaagcatctttaaggtttatccacaaatctgagaaactggggaggagacaatagtctcatatgttaatagctgaggggacaaatgtgactagaagagatttctatctttcttggattgttcatcattcttgcagtacatgcaagtagctacataatggttttgttacatttttctttataggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtatgtgtaacactgacttctggcatccaagtgaaatcttgatctattcaggaattgattattgagcctaattattactgccttctgacttgggctgtttcttagcttgttagaaagggaagacttggatctccctgtagcttctctgtcccttagggtggtgattttctggctatcaggattgtagttcaaaaaaaaacaaccttatcccacaataaatagctattcatttggagcagagcccctgaaaatttaggggttagaaagtagtcttgattggggtacaaaccaacatcatgtacacggttttttccaagatatacttgcccgga

SEQ ID NO: 138336 - DNA, 2082 bp, Homo sapiens
cttctctcttctttttttatgtgtcttcctccccatgtctgtgtgtatgagagagagaaagataatggcagagctggaatggaatacatcaatcatctaattccctcagtttatagatttggaaattaaggcccaagaattcaggtgacttgaccaaattcacatgactaaaaagtggcagagcaaggaacagaagccactactttttccactttactactctgtcctgttatctgcacatttgtgtgtgtgtatatgtgtggatatgtgtctaccccctcctctgtaatatgaaatacaaatagagggtttttttgctatgtgtagaataaaactgttctctattgtgtttgaagtgtttgtgggccttgatttttattgtactctctatggtcagtagcctagtaacagaaatggtttttatgcattcattctgtcactcagcaaatatttattgagcacctactatgtaccaaacatagatctaggtacgggggatactgcagtgtgaacagaacaaagccccttcccccatgggcttacattctagttgggaagacagataacaaacaaataactacataatgcgcttacataattttactggtagttctatgatgcaagacattgcaagtaagggttggaagaacatttctggataatattttgctcctttctctctgctggtacttgaacttattaccctaatactaggtttataccatttttattagtagattcgataaagccaattagatctgaggcaagagaaaatacaaattttatcttcaaacctttaaaaaaattttaaattaatatattaacttataaatatatatattcgttcatctataaaagatatatgtattaagaacttcaagccaggcatggtgacatgcacctgtagtgccagcactctggaggctggggcaggaagaccatttaagtctaggaacttgaggctgtggtgcattctgatcgcacctgtgactagccactgcactccagcctgggcagcatattagactcccatctttaaaaaaaaaaaaaaagccagggtagaatcctgtagtcccagctactctggaggctaaggcaggaggatcagtagagcccaggagttggaggcccgcctacacaagatagtgagaccacatcttaaactaaaaggaaccttgcttcctctcctatgcttgtctcccctgtggccctctaggtcctgtagataatcacttttattagatttttcatgttactttctggaaaacatgaatatatattatttttcccctttcactgttctataccttttttttttttaacttaacaacatgtccttaattcatacttttaaattagattttaaaattaactctagtccacttagttagaaacttgtgggcaaaaggcttattattactagggtgattatataatttatcatctaaaggagaacatgaaagaaagtgctgttactttacttggaggcaaaaacataaactgggactatcttagggaaaccaagatgtatggtcacttttgctagtacttgtctgcctagaacaagcacacctagaaacttaaaatggccgttattgagtggttagatcacaattacagtacctcagattaaagcttcaaaaagattatactcaattccgaattgtgctgctataaactcatgtgaccaaacaccacctgttccccaataacctatggaaataaaaaattttaaaaaaaaagattatactcataggtgtttcagacccataatagctcgttaatgttcagactggtctctggaaacttgtctctggtttcagtattgataatgaacagaacagtgataatattctagcagtctatacaaatctgtactaatgtttcatctatccattgtctttgggaaatgagttaatgcatgtaagtgaatgttccagataatagaactattctaccaagttttttaacttttttaataaaaaattataaaaagtatttgatatttcctttcttgaacaggatacaaaaaaatagtttaatcagttttgactactcaaggtcatcattgaatagattcat

SEQ ID NO: 138337 - DNA, 1197 bp, Homo sapiens
gtcttgcaaagggttgaactcattgaagatcttaagtaccagtaagtatgatatcactgtacttggttttttcactccagtcagtcatattttttggtctacatttagcagaaagcatctgccatatgttctctatggaaagctataaacagcaaatgttgggctaatagcagtctttttcctggaggccttcccattgcctttctgcctctctgacattatgaacatctctgcctcacttgtgggatagggccctttgggacaaactacctgtatctgattgaactagggtagggggtggccctgtgaatgtaacttccccagtggaccagcatacattttctctagactctgttggctttcatttgtatttccagtgagcactagtttccagggtgttctcagttttcactgtgcttatttggctgaattttgattaattcagtggtatccagttgtgctgtgtaatatttgttgatgatgctggaggtgttgtaagcaagtatgtcgaacttgctagttgatctctggctaaaccctgccttctgctattgctaacagtagaaaatgatcttcagagtcattgatttgctttttttactcatatctgtatagagatcataatttgtcacattattactgaattcaggttacctatacattaaaaatgccaaaaatctctcttttctctttgtacacataggtcccagtcatgcagggaacaggaatgcaaggagcaagtatacagggtggaagccagcctggcggctttagtcccgggcagaaccaagtcactccacaggatcatgagaaggtaagcaacactgtctgactgcctccttatgcacaattctagcctttttgattcctcttttcacagttaccatgtgacgatcctgggtcttcaaagtccctttggaggtgatgtttattctaacttagaactcttttatgatcttgttacctgaaaatttgtgagtctggtcctgaagttcctaatggatgtgaagttcttaagtggatgtaaatggcagcttattttatatttcacactcatctgccaatagcaggtttttcttgttcaggccagattgacctgaaaatccacaccctttttccttccctttctactttatccctaaaaacaatagtagattccccatgattatatctttctgtttttatatttgaccattg

SEQ ID NO: 138338 - DNA, 1050 bp, Homo sapiens
ccagcctaagcaacatagtgagaccccatctttacaaaaattttttaaaaaattagccaggcatggtgagatgcgcctatagttccagctacttgtgaggccgaggtgggaggactggttgagtccaggaggtcagggctgcagtaagccatgattatgccactgcactctagcctgggtcacagagtgagactctgtgtcaaaaaaaaaaaaaaaaaaggatccaggtaacctgcttcataaataatcatgtgacaacttgattacacatacatgtatcagtgtttcttttttaaaaaaaatttccccagcattttgtattttataaacagttcttttttctaaaaacagtttaaaattcatgttgccccactatcaggtaggacagcacaatttaaatttctactttttaccccatccatattataattcctattcttatgttatataatagtgaactcatttaactattaataattaccactcttacaaaatatatcattttaatccatacttgtgatgtctttaaacatttaaactgcgactatgcatcatatatgtatttagaccttaaatgaattaatgagaagctatcatagatagaaggctcagtagacttttggtaccttaacgttttattccacaaaccccacatattctttttttttagtaaaagtatagactacctattacattcagaggaataaataaaaattatttcttttactaatttacttaagccagagaaggcattccctacaatgtgagaaaattactccttactgtttctggatagtagaggtagaaatgtttctgaaatttctttcattatagttttgcttataggatgtttaatttaaggccttgcatattaaccacaaggcaaagtttttgtctatttttttaccttttatttttaaataatcatagactcaaggaaagttggaaaaatagtacaaggagtctcatgtacccttcacccagtgtagtgcaaaaccaagaaattgacattggcacattactgttaacttgactgcaaactcagttttc

SEQ ID NO: 138339 - DNA, 2282 bp, Homo sapiens
taatctatgggtcttattgcctagtatttctctctctcgccgcgccgccgcctcctcctctccccccaccccaaccccatctctctcgtagtggcattaaggaggaacatggtttctctctatcaggccaacctcaagaggttaagagttgccttaataatcagtaaagttctactggaactacttttgagccaatttatattcttggaattctatcccctgggttaggattatggtcaggtgaattaaaagcctggcataggcttagagaatgtaatagcatattgcttacatgtcaagcaaaagaatgcaaagataatcaactttttgagtgacaatgaaattgagggattttctactcatataaacatttataagaaatttgttgattaaggtatttcatattacaactttgcaagaaaaacttgctcaaagcaggtgaggagctttctgtgtatcctgctcatccccagttcaacttggatgttggctatgcataggatttattatattcattaccatgaatataatcacgaatttatgcctactcccataaatattcaagccttgggatattgattttggcagccatcatatcttgaagtgagtgtgtcaatatatttagacatggagaccaagagtgatgcctttctcattaggaactcgttgtaagtttcaagattccaaatcaaggtcattgaagatgaagttgtcatttggtcagtagttgtctaataagaatcatgtcttcaaggtttcattgtgcattttcccaaagccttattaaacctgaattagctgaaatccgggtgaacaaattggcaacagcagtggtatccctccctatgtaaacaaccatcagtattgttttactgttgtaataaatgaaacatgattagccaccatgagttcatgacctacctttattgtgctcagactagtgacaaaaaaaaaccaaaaacagttttatccctcaagccgtagaggttcctaaactattagaaacaaccatttgttcattcgtggtcacttaatggtagaaaaaatagataatataatgctaattcagtacaaccattcttctaatctataatgagttgaattgtctgggcacaatgaagtgtgaggtttctctcttaagagccctgggcttctctccttctagggattcactgtgacgactaacatcccagagccagtgtggtccttgtaggccgaggttgggtagatggcagaaataaaaagcattctgatagagaatgaaggcattttgcttatgttattagctgaatgattccttagcgatataggtaggagtccacaaaaatctatgaaaattataaattgttattttttaaactagacattaataaactcccttaatagtgataaagagctcctcttgactaaataagtcatcctaacatggagttcaagttttcacaatcgcttttaacagaataatacaagatgacagtatagctgacttgcaattataatacaatttcaattacaatgagcatactttctagattttctttcccaaatggagagcccaaaaagaagtaacaaaagactcattcatcaagtgaagaagaaaatcctttattttttgatgagcaaaaataagaataaattgctgttcacactggataagaccatatcaaaagtgacagtaaacatgtacactgttggtgttatatggggatggggttctcggtaattttgtttattatttatgtttattattatgttttatcattaattattcaataaatttttatttaaaaagtcaccctacttagaaatcttctgtgggggtgggagggacaaaagattacaaaccaaaactcaggagatggtaacactggaattgataaaatcacctgggattagttgtataactctgaaccaccaaacctctgctatcaagccttgctacagtcatggctgtccagaaagatttacagttatttttctgagaaaggatccatgggctttaagaacttcagaactttaagaacttcagaagttcttaagttgctgaagctcaagtaacgaagttgaatgcaatcaaaaaaagaataccagggagtcaaggcttgagaggcacattcttatcctaaagtgactgctcaaacctgacgagaccaagtaaattactgaagatacaaagagacaaaatgcagattaccgtccttattcctataactcaaaaattttctttgttgaagtagaattgaacctttctaggatccagactggaatatcggtgacagcat

SEQ ID NO: 138340 - DNA, 1097 bp, Homo sapiens
catatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatga

SEQ ID NO: 138341 - DNA, 1049 bp, Homo sapiens
ggggatatatggaaaatcttcctaccttcctttcagttttgctgtgaacctaaaactgctcttaaaagtagtcttttttaaaagaaaaacctggaatataacattattggatgaaacaatcaattatgttaatattgacaattgatttaatagaactgtcttggctctaaaattgtaattttaaatgcatctttgtagaaatgaaactatatcttaaactatatgttcattaaattattttttaaaagacaccactattttggttcttattgccctgtagaacattaaccagctttgattctaatttagcaatcttattttagcattcctttggtgtttttactgactatatataaaatacctgttttcatatcctcttttgagttggctgccaccttactggtttcctcctcaatgagttaaataaatctttgatacatatgaattctctatttgtatgaaacttatgtttatttgttttagatttattttgagaatcatatgttaacaatgatcccatttttgtaaaatacaaaaccaacaatatgggggggtagaggaaaatgtttcaagcttttttcagcagttctgtttgggaaggtgggagagaatactagagatttctcctgtgtttagtgttttgcaacatttagattttgtataaatttacacgatatttgtaatcagaaaaatacattgctttaaaaagtaaatatgtatgaaaatgattcacacacagtgtgtgccctcaacaagtttaagatctggctaaagatagagacatgcttcattcaactaaatagaaatacaaggccagttatgatagatgcctttgaaggaagagggctatcatctgttgagtgcttatgagataccaagggccatcttggatcattaatatagattcattttatcatcacaatgactctgtgaggtagattctgtctctctttttcatataaaaaagctgaagctgagagtaacttgcccacggtcacacagctactaagacaaagagccagaatttaagccctggtcttattccaaag

SEQ ID NO: 138342 - DNA, 1319 bp, Homo sapiens
aaattttccttctgtatattctccccagcttcctcagtgacttaacatcctgggaatgcagagagtttaggggtgtggagtagtttctgacctgaaaaacctgctgccctcacccaaggagaaaagactctagtgatacattatgtaaatgaacccttagaacttcctacagatggtggccttttggttctgtaaaaatcctccagatacacaggagaagatggaattgtgaaatatggtagtggggcagggaacttgctcccttccatttgcaaacacttttaaaattgactactctcttcttactttctgaaatctttttttaaccattttaatgtttgcaatttaataaatctcttgatgattgcagacatataaggctgtttggtggtattcagaaacatcacagtaatggcagttttttcaattggtttgtagtcctcaataattatatattaaattgctgtcaaaccagtaagactgcatttatgcatccatcattttcaggattgttggtaacctgggcatattttccccaaataactttgcctctttgcgtcacaagtcccagtttgctcacatttacctcaatgacagtacctttggtaataacacccaaagttgtatacagtgggaatgagggattcttctttacaccaagtattggtaagcaaaaggtggctttcagttcaggatgtgttacatgggctttcttgaaatgcaagcccattggcctgatgagtctttcatatttaggtggttttcttataaagccatctccaacaaagcagactttagtaaccatcctcttccatgccttcttctttctctttcctgttcgaataacttttaatacttttgtttctccttgggcacatacttcaggcagagggacttcccattttcccaccttctcttttcgtttctgtttaatcatattggaaagtactgtagctcgagattgtgcctctctgtccagcagataggcaggtactgatccccgtggagtcttttcattattcttgtgtttggtgtttctcttttcatgcatcttgatagtctttttcatttgtattttctcagcatggcacggtttatggtaaagcttagccttcagaccatcattttctttgccttctttgaacgttcgtagcctctcgactttccttctttctctttttctcatggtaatccaaacgatatccatagcgtttacagtgtaattcaatatattcgttctgtggcatggtgaaggccgcagagttgccagtagcagcctctggggtgcgaaaatgctctcaattttcaggtctcagaga

SEQ ID NO: 138343 - DNA, 1042 bp, Homo sapiens
tgtgattgaatgtttttgtcacttccctgtataatccagagggttttcagttgtgagcaacagaaattgactggctaatttaggcagaaaacgtatatattgaaagcatattgaatagctcacaaaatcaccagctggactggagaactagactcaggcctatatagccaacatcacagctgccactgttactaccaccaagaggagaaagggactctccctggactacatgatgactcaatggacaagctaagagttgaaagcaacaggaaagttcacgaatcttgggccattaccagatcacctccctagcactagtgagtgcctaccaccaccactctaactgccatcagtgttaactcagattctccaaggagcagatactaagatggaattagatatgcaagagattgattgagggaaatgcccatgacagaaagcgtgagaactggaagaggctggaagaactgtcagactgcaatgtaaatctgacatttatggataagagaaggcaagaagaagtttcggaaggaagagtcttggcctgaagagcagttctaataaaatttgccctagctgatgggagtcctttagccaaagctgcctattggaatagttctgtcttccggaaatggatctgacttagtatcactgctgtgctcagtcactggctggaagcaatgtggcctcaaagaaaagctgcgaatattgggctgaatttagaacctagcagctagctagggccaaggtcatttacattccccatgctgggagaactgaaaggcacattttcgtagctgtctcaatcagagattttccactgctttgggtcgctggctcccagtccaagggatggatccttggattgggtgagccaaggtcatgtgcctgtgttctgactgcaagggggacctgcttcccaccaagattcctaagccccctctcccaaataaaggggttcatatgctggacagcaacccccacaaaggacaaatgtccactatactgtgtgacctccttaagagcaaagatctttgtcttg

SEQ ID NO: 138344 - DNA, 1564 bp, Homo sapiens
ctctagctgccctgaaaaagccatcattgttattagggaagcaaggcatatactcttgagaccagttaaataccaaaagaattggggtcagacagtagagacttaattattcagaaaacaaatatccactgggccggagaatttaaagagagtcttataaagtaagtgaaacttgggcttgagctagagggatgtacagtggataggagaaaagaaggcaagaggttattctgatgggttggagggggtgggcaaatgtttgcagttaaaaaatatctcctacatgagaagtttgaggacaatgactattctaaaatagagcactcatattgggagttaggcgtgtttgggccaggtcatggacagtcttgaatgctatcacacagagtttgggctgtccacataggctgatgttttgccaggcttgcttaaaacatagattctcaggccccaccttgacctactacatcaaattttctgggttggagcctaagaaatcagtattttgagcaagctccccagatgttgatgatgcacattcaagtttgagatctattagatagacagaaaggagcccatgggagcttttgctgaagggagtgatgtgataatagcagtatctttggaagctcaatagggtgggacagtgtaggatgtagaaactagagtaaggaaaccagttaggtgactgttaaagtagttcagatatgaacttcacaaattcagattttctttctggctggtacccttggaattgtcaaattgactcctaaaatttccctgcaggccatattttaattttcaacacaatttgtttgctgttttaaatgactagggcccagggaccaaagcctgacttccttggttcaaatctgagctctactacctaagtgattttagcttagacaagttttcataacttttctgcgtttcaacttccttttctataaattggagatgattatagctcctaaatcataaggacattgcaggtgttaaattagatcataaagggctcacaacagtacttggcacatagtaagcactcaataaatgttggtattaatattatttaaactaaagagccccttagtttattacaatttgtataatagttaaaaccagtcaattacctttcacacacacaaaaacatgttaaatgtgcccatttggtatgttaaaactgagtgctaggctttttgctgaatgagttgtatttcaaagcatagtgcttcagttaattttatatatgattatccttcataaaataagtctaaacaggatgaattgtttttcccactgattgtgttaatctgtgattagttcttggctatgaatgatatatctttttaaactttgtcctttttagattgctactagctttcagtggatgctatttgtgatatttatttctgaagaaaagaatggacactcttttgctcttcagggggactgatagtggaaataaaatttgatttgttatctgggcatgtggcctggtgtcagctgatcccatgacttaccctggaggtgtggcaacaggtttctgaaggggtgagaaagt

SEQ ID NO: 138345 - DNA, 1066 bp, Homo sapiens
tctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaagaaaatgtagtta

SEQ ID NO: 138346 - DNA, 1048 bp, Homo sapiens
ggtaaaaccccatctctactaaaaatacaaaattagccggtcgtggtggcaggcgcctgtaatccaagctactcgggaggctgaggcagagaattgcttgaacccgggaggtggaggttgcagtgtgccgagatcgcaccactgcattctggtctgggtgacagagtgagactctgtcgcaaaagaaaaaaaaaaaggtgtaaacactagttgctcaagctgaaaggcttactgagatattccaagggaaagtactttggaaaaaatgaagtgggtctgtccaaaagcacttctttccttgttacttggagtgatgctagatccaaagggaagatggcagagcccttggctcctgtgcgtttctgtgaagctgaagctttcccttactgctgggcttgagttatgtcctgtgggcctgtcttccataggcatcaccaactctgaatttcatactggtcaagcagagaagattttgccagggctgctaaagtcaaaggaagatggacagtcaattgttgctgtggtgaacccagcccgtgccggactgcgtaaggatgaacagctattttgatgttcccagtattgtccatcaactttggttcttcttttccacaccatgctacgggtgctcccagtgggctggctctgaacctgtttcccctctatttctaatcaatcctgagttctggtcagttggaagtttgtgataacagagaccatggtagttaattatactaatagcaaggtgtttcttccttcagattacaaggtgattcaagccattcgaaacttcagggccatccacacgctagtttttgtttcctgcaagctccatggtgaatccactaggaatgtcattgagtaagtcttgacttctgtttaaaattttttgttctgattatcaaagccattcatgcttattgtacacacaattggaaagtgatttgagctttcaagtcattagaagtgtaaagaaactgaaacaaaaaaaataccacctttaagactcaattacagggctgggtcagggatgaggcaagtcaggtac

SEQ ID NO: 138347 - DNA, 1048 bp, Homo sapiens
gagcagagatctcgccactgcactccagcctgggtgacagagtgagactccgtctcaaaaaaaaacaaaaaaataaaaaaacaaaaagtttaggccaggcatggtggctcacccctgtaatcctagcactttgggaggctgaggcaggtggatcgcttaagcccaggagtttgagaccagcctgggcaacataacgaaaccccatctctactaaaaatacaaaaaataagccaggtttggtggcgtgtgcttgtagtcccagctacttgggaggctgaagtggaaggatcacctgagcttgggaaatcaaggctgcagtgagccaagatcttactactgcactccagattgggtgacgagagtgagaccctctctctaaaaaaaattaaaaaagtatttagttcttcattcccactgaccacatttcaagtgctcagtaaccacatatagctagtggccactgtatacgtagaacacagggcaaacagaacatttccattgtggaaagctctgctgggcagaactgacatataccttgagtgttcagtctgaaaggtcagataaaatgatgagcttgcacaagagctcattcttgacctttcctcattacctttttaggtctgtttttgttccttcattctgggttcctcatctgttgagaccatgagccaagaatctgtgggacactcttcttttgtcctgtttgtttaccattctttgcggtgaagctacaaaagtatttcatttctttttttttttttttttttttttgagacggagtttcgctcttgttggccaggctggagtagtgcaatggtgtgatctcggctcaccacaacctccacctcctgggttcaagcgaatctcctgcctcagcctcccgagtagctgggattacaggcatgcacaaccacgcccctctaatttttgtattttcaatagagacaggatttcttcatgttggtcaggctggtctcgaactcctaacctcaggtgatccacgcacctcggcctcccaaagtgctgggattacaggcgtgagccaccg

SEQ ID NO: 138348 - DNA, 1094 bp, Homo sapiens
ctgccctaagatgcaatctgggaagggtccactttgactggtacgatcaagcatgccagcttcctctttaggtgggcattacatgacagtggaaagtagaataggtcgggagttcaagaccaggctgaccaacatggagaagccccatctctactaaaaatacaaaattagccaggcatggtggcgcatgcctgtaatcccagctactctggtggctgaggcaagagaatcacttgaacctgggaggcggaggttgtgctgaaccgagatcacaccattgcactccagcctgggcaacaagagggaaactccatctcaaaaaaaaaaaaaaaaaaaaaaaagaaggtgtttagcattcatgtggcaatttggcaattaaatatgtaatggctttttattacatttaaacaatgatctatgattcacacaggctttatttcttacagagattcagaaaaatcacacatgagtcagtacattttgcagcacttatgtaggctttatggtttaagatagcaaccaggctgagattttttgccaaaatatatttttatcagtgctttcttctgctttcatatagttttttttccttgtaaatcttattgaagtataacatatatactgaaacatgcacatagcataagtatgcagctcaaggaattttcagaacattcccatgtaacccagcactcatattaagaaaaagcacattgccaggtgctgtggctcacgcctgtaatcccagcactttgggaggccaaggtgggtggatcacctgaggtcaggagttcgagaccagcctgggcgacatggcaaaaccccgtttctactaaaaatacaaaaattagctgggcttagtggtgggtacctgtaatcccagctacctgggaggctgaagcaggagaattgcttgaacccaggaggcagaggttgcagtgagccaagattgcactactgcactacagcctggacgacagagttagactccatctcaaaaaacaaacaaacaaacaacacaaaacaaaaagaaaaaaaacaaaaaaaaccccacatgaccagcaccccagaaaccttcctcatggccccttccagtt

SEQ ID NO: 138349 - DNA, 1087 bp, Homo sapiens
cctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcgcgcgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactg

SEQ ID NO: 138350 - DNA, 1233 bp, Homo sapiens
cctcccgagtagctgggattacaggtgtgtgccaccatgcccaactagtttttgtattttttagcagagacggggtttcctcatattggccaggctggtctcaaactcctgtacgcctgacctcaagtcaggcccacctcggcctcccagagtgctgggattacaggtgtgagccaccacgcccggccgagatggattagttttggacccacttatatgacatagccattctaagagagaacttgcatatgttgcctgtactcttactggttttttccactagaaagctagttcagctgatgaatgttaccttgtcaggttgtttctatttctatttagggcaaggactttctgagaaagtcaacctctagactttgtttcctggattgttgtcaacttatttattgtatgcctgttgtatgctagctattgtatactaaatactggaaacacaccctgtctctgtggagaaaaaaggactgtttggctgattaatgataacttaacacttgtttctgtgtagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtaaaggtggattgttttccttatgaaactcctatttctgtaaaaatattctagtctttttttcttaagaatttttaaaggaaagcataattttgctcattcatgcttttgtttatttaatagacattgagcaattactatatatcagtatgctaggcactagggacacaacaacaaaacttactagcagagtggttcccaaacggctgcatattgggatcacttgagaacctttttttctttttttttttcctccctctctacccctttggctctgagaatctttaacaaacaaactgatgtcaggcatctactcttagactttctgattttattggtatgggatgcaacctggcatagggattttttttaaaggcttcctaggtggttccaatgtatggtaaagtttgggaaccactgtcctaatattgaaacaggttgtagtctaagttcagtgcttttagtttagaa

SEQ ID NO: 138351 - DNA, 1047 bp, Homo sapiens
atcgctgttaaatattctttagttaaaaacatctttgaacagtttttgggaagacacttcttacataaactcctttatttatttttggagacggggtcttgctctgttgcccaggctggagtgcagtggcatgatcattgtacgtttaaccttttgggcacaagtgatcctcccatctcagcctcctgaggagctgggaccacaggtgcgtgccagcatgcccagctagtttttaatttttttgtagagatggagtcttgtcatgttgcccaggctggtctcaaactcctggcctcaagtgatcctcttactttggcctcccaaaatgctggaattacagatgtgggtcaccacgcctggttattaagctattcctttaaagagttccaaattcttattattgaggccgaagactgaaataattttaaaggtctcactatttaatattgtttcttttttcaggtcccattaaagcttcacagaataaagataaaaccttggaaaaacacttgaaaactgtggaaaatgtggcttggaagaatgggttagcttcagaagaaattgatattctattaaatattgcactcagtggcaaatttggtatgttgaggaaatgctttttttttcttttaactcacctagcacctatatttttttcttttaaaaataaatcttatatatatatacacacacacacacacacacatatatatatatacttttttttataatagagacagcatctcactatattgcccaggttggtctcgaactcctagactcaagtgatcctcccgccttggcctctcaaagtgctgggattataggcttgagccaccgcacctggctcgagggggatgttgttttgttttttgttttttgttttgagatggagtcttgctctgtcacccaggctgtagtgcagtggcaccatctcagctcactgctacctctgcctctcgggttcaagcaattctcctgcctcagcctcctgagtagctgggactacaggtgcgtgccaccacacctggctaattttttgtattt

SEQ ID NO: 138352 - DNA, 1081 bp, Homo sapiens
gtgaagagcgagactccatctcaaaaaaacaaaacaaaaaaacaacatgtatggagtatacagatgttttctattttagaaatttttttttcgtgacagagtctcgctgtgttgtccagactgcagtgcagtggtatgatcatggttcactgcagccttgaccttctggactcaagcaatcctcccatctcagactcccaagtagatgggactacaggtgcgtgccactgcacccagcctccttttgatatctcagaaattaatgattaggttatcttgatgtctgctaggacttgaggtgtctcaaaatgcatgcctcagactcgggaaacttttatatagcaagttaaaaaataatctctggctttctattgttacttttcattttttttttctgttaagctggaatttgctgaggtcaaatgtggcctccttaattccttttctcccttttattatagttatttctgtgatgtccccatccctactagatctttacatgcagctcttttggtaagttgagatgcatatttagaggcaggtatggtagaaatgtcatcataattaggtacaaagggactttagactctttaaaaattaagtcacttggaagtaaaaatagaattaatattgaattctccctttgaatttggtgcacatgtaatgtgttggtggtgagactattttaaatttcgaagagttagtggatgggagtgagaaagaaaacaagaaaaacaagaaaccacaagagtggaaagcagagatttttatttttgtgattcattacctatcatcactgcttcctttcttctccacagaatgatagtgtagaaagtgatgagatatattctaattcttgaagccttaattaacagaaattgagataggatatattcaaagccagtctctatgacatcttttttttttttttttgagatggagttttgctcttgtcacccaggctggagtgcaatggtgtgatctcagctaactgcaacctccgcctcccgggttcaagcgattctcctgcctcagcctcctgagtagctgggattacaggtgcccgccaccatgcccagct

SEQ ID NO: 138353 - DNA, 2523 bp, Homo sapiens
aacaatttattaataatgataagagatactgaattttacatactgttggtttttattgccttcaatataacgtgaggtgtggtgtttttttttttttttttttttttgagatggagttttggtcttgttgtccaggctggagtgcatggcgtgatcttggctcaccgcaacctctgcctcctgggttcaagcgattctcctgcctcagcctcccgagtagctgggattacaggcatgctccaccacgcccagctaatttttatatttttagtagagatagggtttctccatgttggtcgggctggtcttgaactcccaacttcaggtgatctgcccaccatggcctcccaaagtgctgggattacaggcatgagctgccgcgcccagcctaatgtgagatttttagatccaagagtgaataatagtaaaagaacaatcgagacactaaaatgtagtttaatttagcttgtctcctttccaggaaatgctgtaaacacacggatattgaagtgcatgatcccagcaacagtaatatcagaagattctgtggttaaggcagtctcctggctttgtgttggcaagtgttctggtagcaccaaggtaatctttttaaacactttgatgataagtccttcagaaccacttaagggctggcaaggaagagccacttatgaagtaatggcattggccttttgtgcaaagcctgtagttttggaacaatatatcttgatgcaaggactatgttcaaacagaaatttttactgagaaataaaatctattattctactttgtgcctgaagcttctaaaatagccctggtggcgggggacggggggcggaattaaactcttctgtaccagttatatttctttaaagataagtattttgtctcttcaataggtacttttttatcgttggctggttgcaatgtttgacttcattgatcgtaaggagcaaattaacttgctctatggcttcttttttgcttcattgcaagatgatgcactggtaagtaaaaattggacagcattaggcatcaatcaaatagtacatgtgtgtatattgatgcaccatatatgcttcagtgtgctacacaatatgtttttccttattttaaaaatatatcaaacatatagaaatgtaccaagataacgtagacatatcaaatatacagaaaagggcaaataataacattctattttgcacctgtctctcagattaacaaatagaaaatttttatcgtatttactttatgtcttcttttaaggaaataaaaatgttacagataaagttgattccacgttggagtcttgtttgctgatctggagcactcattgccatcttttcccttttaaaccacttcaacagagtcctttgagtcatttactctacattttcttgattaacactgcaaaagcctcatcagaattaatgagaaggagaggattacttttcatgagtgccaatggagtgattttgattaaatagcataattatttctcttaaaaacattaataactttaagaaatcaatctactgtccacctggaagactttcaaggaccatcagtagttcacagaccatgtgaatcactcatctaactgtattgctcttgcctttgggaagggaattcatttattgattttattttttaaaaatgatgtttccagtgtgttcattgcattgtcctagccactgtagaagattcaaagtttagcatagggtttctatattccacgaacttgaaatctcattggggaattaaggaaatcacataaattatcaaaaacagtatatgatagtttgaggataataattgctgtaatatttccaggaaggaagaaagcactgtaaatcaaaatgattagttaaaacaccataaagtatgtgggtgttgagctgggccttacaggttgaataggatttgggatttgatgacagaaagtgatacttgatatgatgggaatatttcaagcaaagttgtgaggtgtgtaaattgtgttttaggagaccttaaatagaccagcctgacctaattagaggtggtgttaggtggtaagcctgaaaaagttgggtgaggacagattgtagaggtcttccaatgtgatgctaaggaattggaactttattcagtggggaaatcactgaaaatttttggctagaatatgttgaaagcagctttgtaggaagctatatctagtagttcccaacaatgtgaattaagagagaggctgaaggcaggaatactagttaggaagctgacatgataatctaggtataacatgatgtcctagacaagaaattctcaaatatggtctgtggaccccctggggcttcctgagaccctttcaggaagtccaagaggtcaaaattattttcataataataccaaggtattatttgccattttcactttgttcaccttagcgttgatggtgctaaagcaatggtgggtaaaactgctggccatttaacaggaatcaaggcagtggcaccaaactatactagcatattcttcattatg

SEQ ID NO: 138354 - DNA, 1509 bp, Homo sapiens
agctgcttgattatggcataccaattgtaatttcctagataattttccaagaattataataatcaggtattagcttctcttctggtcctgtctccttgaggtctaaatcaaggatgagtaaactttgagtcctgagtatgctaccagtgagaataagctatgctatgctagtaagtatgactggtcagcctaaggtataggaagagaagagaaaaatacaaggaagaagtaaagttggaaaaggtcctaagagagaagatcacagtttggagagggttgttttatggtggttgacttaaatgtctggttactcattccttgatttttgatagcatcttcctatagctatatctcagcgaaattatggtctgaatatacttttttccttcttattggtatttgtttcctcagtttcttaatagccacagaattgaaaatggaaaacttattttatttcagggaatgcagcctcatctccaggctttgttgtcactgtataagttctttgctcctgctctgatttcagtatctttgcctgtaaggaagaaggtaagggattaaggagagagaaatcatattaagattgaaatatgttatttttggtaaagttaacttacagatttcaactaaaatgtttacagcctactgttttactgtctagtattgtggtactgttttgggaaagtttttttttaggaattggtacttcgtgttgatcccatttggtatatttaatagattactaatcagaaaaaaaaatactttaagtgcatttgtatgggtgtaaaggatttcataatatattttcaattaatgaggcattttagactttatgttgcttcagtttatgggtacctactctcttgtactttatatccaaatttatagatatattttaagaattcagagaatctatggaagacggctctgcttgccgtgaagcaaagaaaccggggaccttctccagaacctctgaagttgatgttaggtccagctaatgttcgtcctctaaaaagagtaagtatctaaagctcaaacaacttgcatggctttcttttattaaatccaaataataaccattcagatcttagaggagattatagatatttaagtatatgtcagttacccaggattctgtgtaagccatattcagattcctttaattgaaacaccttaccagttgcttttatatttgtggtttgtagtctgtttagtccattgatagattattttattatctttcttcagaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagaggtatgtgactggaccatgtgcttctttgcattttctatttgaatttcatggcctttgtttttttgtttgtttgtttgttttgtttttttgaga

SEQ ID NO: 138355 - DNA, 1622 bp, Homo sapiens
taattttaaggcagtaagaaggtagagggattttgttaaggaaacactgctagatggccaccaaaactcactgggtggctccactttgatgactatcacaatccaaggattcttcatctttgtatgttcagaaacttgctgttagggccccagaatcatcctgttaatggtaacgaaactcagaagagacaaatgtacaagccagaatgtcagcttattataaaattaattatttctggtaagcgaaatgctcatatctgccaactagagtatcccctctgctatcagcatatatgggagccaaatttgtcattagaagatttcttaattatagaattaaaggaaagggcagtgagaagtctttcatccaagccatagtaaagcctgagcatttcattcctccaatggtgggggtcggtggggaggggcgggtatatttctctagagataatatttcttttgaccaaatttgagtgtttctttactggatactggataagcaactcctgattcttctggtggttaaagttgcttttagttggttccaggccaattcttcttcttcttctctgaatcttttaaacagaatatgatatagtttattagatttccatgtactaaatttgtatcactcttacattatacccagcatactctaattgaagtttagggtattctaaaactttcaattcagatgtttgtactttcttggattgctatgtgatataaagcttatcatattcattatatgtgaattctctccatttctataagcttttccctatatttacactataagcttttccctatattaccaagttgttgaggaatatctcactatcatctccatgtgactgttccagtctacatcatgagttagctaggatgtatgagacttatggcttttttactttgtcacttgtcactttagtgataattatgttttgtgcacttttttattgtggtacaactagatgcttatatttactgtttctgctctagaatgtatttggtacaaggtgaataattatgaacatggaaaagaatttaccaacttcctggataccatcatcagggcagagtgcttcttacaagtaagatttcacttgcttcttccactctccaccactctttactaaaatttatttagatatccattgaaaaccttttcttgcccggctgcggtggctcacacctgtaatctcagcactttggaggccaaggcgggtggatcacttgagcccaggagttcaagaccagcttgggcaacacagcaaaaccccatctctacaaagaatacaaaaattagccaggcatggtggcatgcatctgtagtcccagctactcaggaggatgaggtaggaggatcacttgagctcaggaggtcaaggctgcagtgagccgtaattgtgccactgcactgcagcctgggttacagagtgagatcctgtctcaaaaacaacaacaacaaaaaacccttttttttagtacctgacatcttttgtaaataatatttgttcagtttgaagctcattatagataaagctgagttttatctttgcactgttagatttgaagaaagaatatgttatattatgcaaataaaagggaaaagcctgtaa

SEQ ID NO: 138356 - DNA, 1038 bp, Homo sapiens
ttcctgtgaagcattcctgtataagagccttcctctctgggatggcctttgttgtcggtcacagttccttcagcttgtgagctggattccttttagtagcttctctggtatgtatcatgaaaatttggagtcatttgattcaacgtactatgattgaaaggattttgaataatcttttttttgattcctagaggtgaaaccacttctttttgaccatctagcgcagctcttctttacatcaaccatttatttcaaggtaacaaaaacttgtcttgcttagattcaataggatgtattattctattgctagtggtacacaattccaaactgatattacagcaatggttttataacaggattttcttggacctgggctttgaggtactgcatcactcaactcaaagttaatgcatagaatgttccttttttaaggctgtgttgcatacagttttcctgacctgtttccacttgtagcaaatgacatagtgaacgaacaagtggcagatgcatattaataaaaacaaacaaactgagaaatacttagtttgattgttgtggtttatatttttgtagatacatttattcatttcacaaatattttttgagcacctactaaatacccttcttgacactgggaatatagtagtgaccaaagcaaacaaaactccctgtgacattcatattttatatttatagtaatagtcgttttctgctagtaaaattgttccaaccttatatataatatgttactattttggagtggtctccaagaagaccaatatggcttccagaagttctacctgaatgagtttgagagccactttcttatagaatggttattcctattctagaagaggggcaattaagtaatttttcttttataacttttttttttaaccttaaatcacttactgttggccacattgacaggaaacatgttgtcctggttagcgtttgtcgtaattgaatggcacttgattaattacctatcatattaacttggatttgaggtctatttatgctaattgtaacttttac

SEQ ID NO: 138357 - DNA, 1238 bp, Homo sapiens
tagagaaaatggcaaaataaacttgtacttggcattcgtctgtcttctggagactaatcatggtgtagaagcagctgttgggttcaaaatttgatgtggtcatctccatggtccttttcatctctaagcctctgttagttctgaacactgttatgtctgaatgatttcatgaaatcttttttcattttgtccccctcagtgtagtgtgcttcagagtctgaaagagctattgcagaattggctgttgtggctttctatggacattcacatgaaacctgttacaaacagtcctctgtgagttatctaacggtcttccacaagagacgatctgtatacaaatgtttgcatatgtttaatagtgtggcgtgaaacaatttttttcatgtaaatgcttagtagtacttttttggaagacttttttgtgacttttcactcttcttcccccacaatcctgaaaggaaggctaattctctaagttcctattgtgtaaatcagaaagcaacccttatctgctaaatgacttctttcaagagttaatataacaaaacactagagagatgagactagaatttgcaactttgacttccattcagtttaactcattttataaattatattcttatatttaaagccaattttcatgatggctagaaaaatctctaacgtaattttgcgtacaactttgtttttatgtttctgtgctgtattttggttatatgtgttaatttatcttaactttggagtttaaaataagagccctaaattgttaaatgtgtgctttaccttcaaagtaaaagtaaaagactaaatttcaaggaactgcataatcaggttgttttgactctttctacctaaaatctttgccttctcctacatatatatatatattttttgagacagtcttactctgtcacccaggctggagtgcagtggcacaatattggctcacctcaacctccacctcccagcttcaaatgattcttctgcctcagcctcccaagcagctgggattacaggcatgtgccaccatatccagctaagtagagatggggtttatttagtagagatggggttccaccatgctggccaggatggtctcgatctcttgaccttgtgatctgcccgcctcagctttccaaagtgctgggattacaggtgtgagccactgcgcctggccaagaaccactattataaagaaattccacttaaacatttaatctcttctacctaaattacat

SEQ ID NO: 138358 - DNA, 2589 bp, Homo sapiens
tggtgcactctcgctcactgcaacctttgcctcacaggctcaagtgatcctcccacctcagcgtcttgagtagctggaactataggcatgtgccaccaccgcacttaatttttgtattttttgtaaagacgggcttttgccatgttgcccagaatggtcttaaactcctggattcaagagagcccccgaccttcgcctccctaagtgctggaattacaggtgtgagccactctgcccggccctgaatttttcatgtcacttttatgtgaactttttttctccacttaacttttaatggaatacctattttttaatggtttttatatatctcacttgagaattttcatatctgcttggagcttaatactttatttctctggtatttactagtagagtctgattgcttagaatgttctatgaattcgtcttaatggttccctggagggctaagtgtagttttatgattactcactgtgattttttaaaaagtgaattatacgttggagcactgatagtttttaaaatcctcaccaacattttgctttatattattcagctttagcttggaaattgtgaacactattgctactctatatctgaatgttatggtttcttattgcagagagacaactttgggtggatccatgaactctgtgtctaaactgatccactatgtagggtggctatccactactgcaatgcgcttggagagcaacaatactttcttgctgcactttattttggatttctatgagaaggtagtacacattacattttccccatttggatttatgtgaaggctatccactttattggcttattatttaaatttcatgcacaaccattaaggtgggctatgatcttattagcatcattaaaataacctcacattttgaagttcatgattattttctcaccagaataactgactttcataaacaaagtggaaaaacaattgcttttatttagggccaggtaccactacattgacctgtgttaatactggccctagagagaagtctattgttagcattattttttgttcatcccattcccaactcctggcagaaaccaaaaatatcttgttgtttcttcagatctccatttctacctttcagctgccttacttctcttgctacctagtacgcttttattgttttatagtatatgacctggacagaactataggttggtgcaaaagtaattgcagtttttgccattgaaaacaatagcaaaaactgcagttacttttgcaccaatttaatattatccatgaagtatccattatagtctcacttttcccagcttcctctctttactaatacctagttgtcttgtgttatgcatttgcttagaagcatgctcctttgttttctaggttgacagctaactcacatggtaagtaaatattatgggacttaaggataaagaaatacttccttaatctaccctgtccccctaactttaagacctttccccccaaaaaatgaaagatttgagtaatggccttctggaaataatcctctatagtgtggctgatgtttggtgaagtatattttaagccagcttgtagatgtttatttaggagtcaggcatgtccaaagctaatgttatgttattgcttatcttgtactgatgattctttgggtgaacttagttgaggagttctggggaatactctgtatactgatgttatcattcttcctccaaggtgtgtgacatatatataaattataaccttccattagtggtattgtttcctcctgggatcttctattctgcactcctcagcctggataccagcatcctgaaccagctgtgttttattatgcacaggtacaaagcctttttaccattttatgaaacagtgtattataattctctcttcctctttcagctataatacaataaatattcctactcgtcttctgccagggcctctggaaataggaaatgtggcttgcttttggacatgaccttccgatatggggccatggtagctgtgttttttaaatcctccactgctgtggctacagaataaaaaaaaattcatagttaaggacttgttgtgcaatggtactgttgcactcagcattgttcattctaattgctgtgtcttcaggaaaaattagtcatttggtgataattgcttgaagtgtttgtagcttctctggtaaaaataacattttctgggcgataaggggagctattgccaattatatgaaactgtaagtattatttctggtctcctctaattctttcacttgtggactgaaattactttcttcagtccataagcgtagactttttttttgagatggagttttgctcttatcaccctggagtgcagtgacatgatctcggctcactgcaacctctgcctcccgggttcaagcgattctcccccctcagcctcccgagtagctgggattacaggcgcccgccaccacgcctggctaattttttgtatttttagtagagatggggtttcaccatgttggccaagctggtctcgaactcctgacctcaggtaatccacccacctcggcctcccaaagtgctgggattacaggcgtgagccaccatgct

SEQ ID NO: 138359 - DNA, 1104 bp, Homo sapiens
tagtcaactacacatcttaagtgtacaacttattgagcctctattttcacttgaggagaatgtatcacaaaaggataaaatccttaactagacaactggatatttgtgtatatgcacatttgcatatatttacatttaaaatgtatgttttttttaaattttaccatttcaaaggcattatattcaaaggcatgttaaatgtttcattctgtttgttttttctgttagatatcgtaaaaatttgactgccgcaaagaaaaatgagttggtacaaaaggtatgaatgagaaagctctgtgttaaatcactgttgtttaaaaattaagtctagatatatatgacctgatgggagtaagaaggaaagggagaataggtgatagtgacaattttttatttctttcccattagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacaggtaagggtatttaaagaatttttagattttgtatcttaatactgtggtggcagaaataggaagtgccataaatttaatgtgtctgaattgtaagacgtgtgtttagtaattttttttaagtaacaactaaattttgggcattgtgctaggctcagggattccagttaatttaagtaagtttctgtcctctaagagagcttgagcttgtaacagagacagacttgtaaacaaattactataatacagtgtggcaaaatgagaaaaggttcagttgtaagaaagatgggggagtgattagtccagtcctgcctgggtagaggtggtgccatgtaaggaaacgcttcatagatgtggaagctctcataaaatccttctagacaagatagaatatgtaggttagttaatagtacaattagagtcttagtcaaagactgctgatttaatggattgatatcaatatgcaggcaggtggaggag

SEQ ID NO: 138360 - DNA, 1496 bp, Homo sapiens
gaggattgcttgaggctgggaagtcgaggctacaatgagctgtgatcactgctgcattccagcttgggcaacaaacagagcaaaaccgtatctcaaaaaaaaaaaaaaaaaaatatatatatatatatataattatctcattatcaaaaactgctatttacacatttaatataggcagtaatataataatatctgctcctatgttatctcctagagtgtgagaatgatgacacatttccattgcacagtacttaaatttttttgccaacataataaaatggacgtttagcccttggaattgggtactttctggtttaaatgttacttagtgactgagctcatttcccccccgaactaattttgatatgtgcatgcgggatgctgcaaactcttcctagggaaagaggaggaaatagagaaaaagcatagtaaaatattcgataagtaattttcctttttctgtgcctgcagggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactgaacacactggactaaactcactcctcattgctagagcaaagtggctcatcttgagttcccattttcatttcactgacagactgccatcctcaaggagtactcagactggccttctgttcatggcttaggagagccttggtgtgcctaactgatttttcaaaatttagatttttttagcctaccagtgaaaaatgaccccttcatcatcaggctctgcgttctaccaaattgtatgtaaaaagacacatctgttttgtggtaggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactctaaaagccctaagtagttggtaacttcctgggccttcaatcatagcaatttgatgagggaaggaaggggagaggatttgttgggtaatcaagacattcccgtatatgtctgatttcatggaactgctctattttgtttgtgtgtattgtatatgtatatgtgtatgtgtgcgtgtatgtgtgtgtctgtagcttcagtttttaagtgtaaggactaaataaactaactgaaattttactttcagaaggaattctgaagttttaaaaaagttaataatagctagaatatcttgctgaaaatgtactataaaattttgcctgctgggcgtggtggctcacgcctgtaatcccagcactttgggaggccaaggtgggtggatcatgaggtcaggagttcgagatgaggctggccaatatggtaaa

SEQ ID NO: 138361 - DNA, 1055 bp, Homo sapiens
gtcttactctgtcatccaggctggagtgcagtggtgcaatctcggctcacaacagcatcaatctcctgggtttaaacgatccttccacctcatcctcccaagtagctgggaccacaggcatgcaccaccacacctgactaacttttatatttttagtagagatggggtttcaccatgttgagctggctgatctcaaactcctggcctcaagtgatctgcccgcctttgcctcccaaagtgctgagattacaggcatgagccacggtgcccagccatactttcttatttatttgtatcactcatcattttttgttgaaaactagacttttgaataatctgatgtggcaactttggaaatcagatgctctctctttaccaaggtttattgttgttttgacttgtttttactaatgtgggtgggtggttgttttagtgacttctctgaactagtctgtattctttgtcatatgtgaccactgaattctctactcagctattttagagattagttcatgattggacagagcttcttaaatgcccagaaccagcaaatctcctagtctttgtcaaagaactccgtgtgcatgttggggtgtactttcaacaatcacccaggccattaacaactctgccttagtgttcacttcctgattgtgcaaaggctcaaggtcagccaaacatgacagtgtggggccttcttgagtctttccagagcatgtttacagtcctatgcatgcttatgcccttctagatcttctgaaaaatgtaggaggttttcaaagtgcttatagatatattcttccccaatttttctgtttaagattttttattagtctattgtgtaccttaactgttattcacagccttaggcagctgcaaagctaaatcacttgcctgtatttgtttttggcaaatactccccctggagaaggctttttgcactgtgttatctctgagcaagtggtattttccagggaaccaccagacatatataacaatgacagttgtttaggaatgaggctttgaataagctcccacctctttctgctccctca

SEQ ID NO: 138362 - DNA, 1093 bp, Homo sapiens
tcccaccactgcactccagcctgggtgacagagtgagactgcctcaaaccccgtcctccccacccccgacaagtcacccatttaaactatacaattcagtggcttttagcatattcagagttgtacaaccaccactgcagtcaattttagaatagtttcatcactccaaaaagaaaccctgtatccattagtagtcactccccacttctccagaacctctcccctgcccagcactaggcaaccactcatctagtttctactaatctactgcctattctagttatttcatacaagtgaaatcatataatacatggtgttttgagtcgggctcctctcatttagcatattttcagggttcatccatgttatggcatgtatcagtacttttttccatttaaaactgactaatactccattggatcaatataccacattttgtttattcattcatctgctgatggacatttgggttgctttcacttttggctattatgaataatgctgcaatgaatattgatatattagagaatatactttaaaggtagaattgacaggagttgggtcaattactgggtgttgaaggagaaggaatcattaaggatgtatgtatttctaacttgaacgacaactgtatttttcaaagccacaagagagtgtacagggcgaagagagaagaaggcaatataggctaaatgagggtcaagcagctgtatagaaaatgtgtgctgactctaaccttatactgttgagggttacaattttaaagagactggagttggtattatgaggatgggcttagcatggtgctcttgaagtacaggcactactccccacccccatccccacaaggctagcggaatttttatgttctatatattcccttcctctcagcaaatcacttatccaagtactgcttaatactgctttaaaacaatcagatgaacagttaatgccaggattgttttagtacccaccaaacatctttgttttcatcaatgtaagtacagttgtatgctgcataacaacattttggccaatgacagactgcatatatgatggtagtcccataagattataatggagctaagaaatt

SEQ ID NO: 138363 - DNA, 1137 bp, Homo sapiens
tgtttctgggttctccattctcctccactgatccatctgtcaatccctccaccaatatcacagtgtcgctatataattggtcctgaaattagaaggctgattgctctgactttacttttctttgtcaatattgtttagccattctagagtccatatctttatttatttatttatttatttattttttgagatggagtctcgctctgttgcccaggctggagtgcaatggcacgatctctgctcactgcagtctctgcctcccgggttcaagcgactctcatgcctcagcctcccaagtagccaggattacaggcatgggccaccatgcccggctaatttttgtatttttagtagagacgggtttcaccatgttggccaggctggtctcgaactcctgacctcacgtgatccgcccgccttggcctcccaaagtgctgagattacaggcatgagccaccacgcctggccaaaagcctgtatcttttaatataaattttagaataagcttgtctatagctatagaaaaccttgctagaattttggcaggaattacattaaacttgtagatcaatttggggagaactgacatttttactatattgagtcttccaatccatgaacacagttgccttggcttttatactctgtaaatcaacatttattgagtgcctactaaatgtaaaactaagttaaggatagttgtagagctctttaagctttactgaaatataggtatcataatataacttgtttattgtgttttatttcataggtccctgatgtcaaagaaatggaaaaaagcagctttactgaggtagagcaatcataatataacttcatttttacccttaatgtgttttatttaatagctcattagtttcaaatgaatcaaataaaccacagaagctacttttgagccttccttctcacctctaaccctcatcctaaacacatacactgggtttgattcactaaaaaatgaattcattgtttgatgtttgataactgctagaggaaaagatacaatttggccagtgaccccgtgtattctaatctgctctttttattctgatatttatttcaaaagccattccttgggagccagagctcacttttaacagcagttgtttgcaattg

SEQ ID NO: 138364 - DNA, 1113 bp, Homo sapiens
gcctcaaaaataaaaagaaaatgtgttcttaaaacctcaagtcataggaacggttctttagtcttttccttattattatatttattatgttatttattactatattatttagtttttttttttttgagacagagtcccactctgtctccaagccagcggcacgatctcggctcactgcaatctctgcctcctgggttcaagcgattcttctgccttagcctcccgagtagctgggattacaggcacacaccaccacacccagctaatttttatatttttagtagagacggggtttcaccatgttggccaggatggtcttgatctcctgacctcgtgatccacctgcctcggcctcccaaagtgctgggattataggcgtgagccactgcgccccaccttatttagtattaaagtgttctcattacttgtacacacaaatttaaatgtcttagctttacagtattgcttgctcagcgaatatatgtcatgagaaaggtctgtcagattcatacagtaaacttgagcaccaattatgtgttttgacactactgggcacaaagacaatggaaaagaaaaggtgtaacaaatcccctgtctgagattaataagccccaaggcaacaatttgggcttttgtttgttttgtcaatctgagaaatgcagtttcagaactttgataggtggtactgttagccctgatgacattcaaagtcctcatttcaaatattcaaggtagaaaattcaaaactcagttgtaaaacaaaagaattggattagcagacccttttcatgaaatgaaatcttacttagaagcctgttatgtaaagcagaaaagccaagctactctggtggttagtatctggaagccttcctactgttgtgttgtcacccacctgcactgccagtgatgcctaaggctcatcttcaagcttccaggttttaccaagcacactctgaaagtgagtctatgtattagggataacagaaggaaatcaagcaaaaacttgctctttatttacaataaactccataaggaatttgaattctaaagttaacaaatcaatgaactccatgtaaaatagtctttacatggaataatggaaaacaatcgatg

SEQ ID NO: 138365 - DNA, 1546 bp, Homo sapiens
tagaaagcttgaaagtctttggtatctctattaatcatgcagcctccctgaagcgccctatctcagtattccagaaagctgctgtgtagcattagtttggcatattcctacactgagaactcgacaggatcctccaggtttaagccctcttgttaactcctgcctctgaatcaaagatgcattaagcaaaaacagtgcctgtcacagcacgcatgcaatgttatttgaatgaatctgaaagttgggcacaaactgccatagcctcatttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggtgaggagcctggggctgggacctgaacactgtacctactttccctctgtccttgtaccgcgggactcgcgacaacgtcggggattcggggtggggggcgggcacctggcagcaacccttgattttctcaggttcctgtggcctagccggatgggagaagggtgactccgcttctctggggactgtcattccggacctcggctttgttggtgtagaggactgggtatcaaagaagacttatgccactggacacccagcactttcaggcacccgaggttgaagctgcctagtgctggtcaccaagactgatcggagcccccagtactgggattttatttttggcagcccgagtcccagagagtcagtgaatcagtgaatctgctattcctggactcctcgggatttaccttcattacccagttctaaccctctccgctgaaaaatgagtggctccagcccagtaactataaaagtggtgtaatctcttccaacgtacatacttatttgctttcttgttggattgttgtgtaataccaagccgttttgggtctgaaggttgaggaattgagcctgccctgtgaggggactttggcaaaagggtggaaggtatttgca

SEQ ID NO: 138366 - DNA, 1038 bp, Homo sapiens
tgtcagtccacaatcttccaggaggaactctctctctctatatatatatatatttatttatttatatatattttatatatatttatatatatatataacacacacaagtgtatatatgtatacatatgtatacatacactggtgtatatataggtatattatgtatacatacacaagtgtgtatatatatatatacacttttttctactttcaacatattttttatttcaagatatatattaaaattagtaccatctgaatcaaatgatgccaccacctcaaattagtgtatctgtcttacctttaccccccaaacaccctccatttatgagagctggagaggtcaccatgccctcaaatccagaagaatcacactcaaagaaaaaggagttgacgacctgatgaaagaattaaaatgtcaaactgctactgttgtcctttcctccctaatcatggaagtggattgttctcaagtgccctagtccctgatctcttccctgcaactccctgctgcttgcctttgcctgctactctccatttccatgaatcttcaatgccaacctgggtttgggaaagggatacagtgtgctatgcacatgacagatgctcagtaaatagggtttgagtgagttgactgaatcactgacatggacaagccctggagggtgctgtaacctccaatctgcttatgaccaggagccactcaagcagcactctcccttcacaggtggtattccaaacacatgactcggagtcaggctgagcaactgctaaagcaagaggtaagtgtggaaccactagcacacagcattctccttgcataagtgaggatcttgaactgagggcctgttctgccccctacctttgggcaaggcagtgtcaaagctgccatcgtctgggatcccaattacaccattttttttgtttttgtttttctgagacggactctcggtctgtcacccaggctggagtgcagtggcgtgatctgggctcactgcaacctccgccttctgggttcaagtaattctcctacctcag

SEQ ID NO: 138367 - DNA, 1068 bp, Homo sapiens
tgcctgcgatttattcggctaagagaagtacaccagacatggtttgttgggatgcttctgaccccatttactggtcacagtactcaatttatttagggttttattttttatcctgtaatttgagtctttgattgtgaagaggtacttaattataatttgccacaagaataattgtggtatgattacagggctctcaatgagttggtagttcctgagaatagagtagtattatttggttaccactactcctgagtaaatgcataattgtaatgttaaaatgaacctctttgagtttagagctaaaactgagtgttgggaagggctgattgtaaactcatcaatttgtcactccagtgagagaccatttaaaccagggagtcagggtgtgtggcagggtggagggaaaggtttgcactcttgcccaatttttctcaaaatctaatttacaaaatattgaattaatccacctccagaagatagtggcatacacatggtagataagtggcaaagcgatcttccagaacacccctggtgttcctttgacgtattttcgtctccccagcatgagaatagaacctcctacaccacaggaaagagcaaaataacagtgtggatagcccccaggctttgataaaattcactcccttgctttcctagtgtgagcaataatctgcttaaaaagtagaaaaaaactgctggctttattcattctgcttccacggtgccaccaaaagcataaggagtttacttaaaaaatagacacattcccacccccacccccccaccagaggaaaaatccctaccactaattaaacttgaatggagggctggtggttttttcgttacttacttagtgtttttttgttgttgtttttgattttgttttttgagacggagtttcgctcttgttgccccgactggagtataatggcacaatctcggctcactgcaacctccgcctcctgggttcaagcgattctcctgcctcagcctcccgagtagctgggattacaggcatccaccactacgcccggctatttttgtatttttagtagagacggggttttg

SEQ ID NO: 138368 - DNA, 1102 bp, Homo sapiens
tctgggaaaaacactgctcccttcactgaacgccactacgtagcagagtccaccaaaagagataaagtgacgaaacgttgaaagctgcggggcgggaggaagtcggggtgagtggaccaccctttaggcggagtccttccttaagctcccgcccgcggctccgaactgagtcctctcagccgcccgagggcgctgcgctgagccttacactctatgattgctcctaccgactcccatgaggaagtgcgatcgggaacctcctatatacttccgtttgcctcgcggtttctttctttccgcgccgatagcgctcacgcaagcatggtaggacttgctggtgggggccgagtaacatccagcttaatctttcccccccttcgtcgcccgtgctatgccgggatgggtccaggctcctgtgtggactcgatatatcagagcaacccaatcttgccgggatcaaccctaaagggaccgggctacggggccaggaattgaagtgatgggttcaaagaggtagagttagccgggggtggagttaatgaggtctcttccctctttggggctcgacggagggaggaagctctgcttgaagcacatggggctggcccaccctgtagtcagaggtagcaagtaatgaggagtcctcctggagtgcctcagctttagctgggtaaggtagggcgttgtgccattgtggtcaaataacattgcacgttctgaactgtttctttactaggttaacgtccctaaaacccgccggactttctgtaagaagtgtggcaagcaccaaccccataaagtgacacagtacaagaagggcaaggattctctgtacgcccagggtaagatggattccgcataatttggtgttaatgtgacatttgtgttgtagaataacatacgagtccgggtctctctccctccacgcctggcttgagcgttaatatttctgctgcgaaattaagataaaacctgtaagacttacttgctgatcttcagtattttataacaaataccaattcgttttcccaggaaagcggcgttatgacaggaagcagagtggctatggtgggcaaactaagccgattttccggaaaaaggt

SEQ ID NO: 138369 - DNA, 1074 bp, Homo sapiens
gagatggagtctctgtttccctggctggagtgcagtggtgcgatctctgctcactgcaacttccgcccacctcccgggttcaagtgattcttctgcctcagcctcctaagcagctgggattatagacacgtgccaccatgcccggctgatttttttgtatttttagtagagatggggtttcaccatgttggtcaggctggtcttgaactcctgacctcatgatctgcctgcctcggcctcccaaagtgctaggattacaggcatgagccactgtgcccagccttctctttattttttttagtccacaagttctacacattttctcttaaattcactgatttttagattattttctccctatggcttaagagtatactgagtactatttaaagcaaagcattgcaaaagaatagttgccccactattcatttgcaatgctttgctttaaatagtacttaaagtagtcatttttgaagaaagtgatcttctgtagttatttattaaggctttaatttaattttttttcaggctaaaactacaaagaagattgtgctaaggcttgagtgcgttgagcccaactgcagatctaagagaatgctggctattaaaagatgcaagcattttgaactgggaggagataagaagagaaaggtatataattatgggtggaaggtgcaatctttttcatagctttattatttgaaaaggtgaacatctattcattgtggcatagagctcaggggtaatcctctaaaaatattagatctatagctaaagatatgtgaggtcttttgctacaaggaggaaaggaagaatgaggcagcttaacagcatggtgagtattttaggaacagataatgttcttaatggggcagtagttcatggcaaaatacaaaacaacttttttctgttctgttacagggccaagtgatccagttctaagtgtcatcttttattatgaagacaataaaatcttgagtttatgttcacttcatttgtttgctgttcatcttttgggagggaataagctagagccatcaatacaattccgcttgtggggaaatttatgcctct

SEQ ID NO: 138370 - DNA, 1936 bp, Homo sapiens
gattacaggcatgagccaccgtgcccagcctctacaaactttttattccattaacaaactatatgcctgggatttaagttttcttaatacttgatggagtcctatgtaattttgcagcttttaattttactaagaccattttagttctgattatagaagtaaattaactttaagggatttcaagttatatggcctacttctgaagcaaacttcttacagtgaaaattcattataagggtttagacctccttatggagacgttcaatctgtaaactcaagagaaggctacaagtgcctcctttaaactgttttcatctcacaaggatgttagtagaaagtaaacagaagagtcatatctgttttcacagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatggtaaaaacttgagccctccttgttcaagaccctgcggtaggcttgtttcctattttgacattcaaggtaaatacaggtaaagttcctgggaggaggctttatgtgagagtacttagagcaggatgctgtggaaagtggtttctccatatgggtcatctaggtaactttaagaatgtttcctcctctcttgtttgaattatttcattctttttctcagttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacaggtaaataagagtatatattttaagatggctttatatacccaataccaactttgtcttgggcctaaatctatttttttcccttgctcttgatgttactatcagtaataaagcttcttgctagaaacattactttatttccaaaataatgctacaggatcattttaatttttcctacaagtgcttgatagttctgacattaagaatgaatgccaaactaacagggccacttatcactagttgctaagcaaccacactttcttggtttttcagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgtttattttattgccaactactacttcctgtccacctttttctccattcactttaaaagctcaaggctaggtggctcatgcctgtaatcccagcactttgggaggctgaggcgggcagatcacctgaggtcgggactttgagacccgcctggacaacatggtgaaaccccatttctaataaaaatataaaaattagccaggtgtggtggcgcacgcctgtggtcccagctactctgggggctgaggcatgagaatcgcttgaacccgggaggtggaggttgcattgagctgagatcatgccacctcactccagcctgggcaacaaagattccatctcaaaaaaaaaaaaaaaagccaggcacagtggctcatgcctggaatcccagcacttttggaagctgaggcaggcagatcacttgaggttagg

SEQ ID NO: 138371 - DNA, 1048 bp, Homo sapiens
tttattcagtactaccacagtagaggaaagagccaagttcaattccaaatacaacaaagacaggtggagatttatagccaatgagcagattgagggggtcagtggatggaatatttaagaagacatcaagggtagggagcttcttgctaaagcttcatgtacttaaacaagaagggtgggggatgagggaaattgatcagatatcaatggtggcagtattgacttagcaggattcttgctaagaggtcttgctaggacagacataggaagccaaggtggaggtctagtcgaaaagaaggctcatcagagaagtctaactaaagtttggtcaagaagagtctttgtcaaggtaaatctatcatttccctcaaaaggtaattttcaggatcccatcaggaagattagcatggctgctagctttctcctcagttctgggctatagctcacatgcctagtttgaactagctcagcagaactgggggatttattctttgtcttccaacaaactcatctggatgattttgggggtttgtggggaaaagcccccaatacctggtgaagtaaccttgtctcttcccccagcctggaatggttctctctttctgctacctcacgattgtgcttctacaatggtgactcttttcctccctctcatttcaggttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggtaatgtttcattccagagatttagccacaaaggaaagaactttgaggccatggtagctgagccaaagaaccaatcttcagaattttaaataccctgtcacaatactggaaataattattctccatgtgccagagctcccatctcttctctttcagttcattaattaattaattaattcatgtaaaatccatgcatacctaaccatagct

SEQ ID NO: 138372 - DNA, 1403 bp, Homo sapiens
gacttattaaataatgacgttattgtttctctggcaactgggacggttatccccagaggtagaccaataatcagtcacgtaagacgttccgctaaccaatcaccctcttcctttcttgatattgacccgccctatttccataccagaaggaagtgcggcaccttagtgatcccgagtttaagccgagagttgctcacgtgaccgagatctcacatgacgtaggcgctcacgtgattactcgcttacgtgagcagaagtagttctggtcgtcgtctaccgtctcgctatagccgtttgagggaagaaggaggaaaattacccggtatcgttagaggttggtgtgtgggtgggaactggggacccaggggtggtgatgatgaagaccagagcggggttcgggggccgcctccgcctctttcgttctctgctttcccctcccccctcgcgctctctccctcctcccccccatctcagtgccgggaagccgcctgtgctgcgcctggtggggaaatggtggacgctcatgactgtgtatgtgtttttgtatatctgtctgtctgggccggtctcgggggacccctaagggtgaccgtaaggcgaaaaacgtttgaaaaccacggccctgagttaagaaaaacagatactgaaaatagtggtctgagtgctggtctatccattcaggcactcagtctccactgcctgattgtctgtaaggggaggccccaagtgaattttatctgtagagtcacatctaggcaaatgcgtgcttgacaaaggcgcccaataaattactttactgaatagagtatttgaataatgtttatttttctgctgataacaacaatctacatattcaatttcgaacatttgaaaaataacaatatagtataaaatttaaaaatacacataattcaccacccggagacgactgctcaacctgatgtcgttacagttttttaaaaaatgtgtataacacacatataaatacacaaattcttaactcacaaagagtcctggttcccactttagccagcagtcctgatggccttcccaggagacgcagtaatgaagtagaacctctctgcccctacagaagggctcttaaggaatagagcggtgcagggaattaaatgggacgggttatcccagggataaggcaagcaaaaaaaaaaaaaaaaatcctgcaaaatgaaataaaaaaacagcttgtaaatctgtcactgagaccttaggatggttaataggaaaactgttatcactgcagatgcagtgtgctaggcacataatcggcaatcagtaaatgtttgttaaatcgtttcctcagtgtagttttatggccgttattacactttgtactttgtttccaagaggcccagtgctcccagaccatttcagataaacca

SEQ ID NO: 138373 - DNA, 1838 bp, Homo sapiens
gataaagtataattcattcagccattcctctaatgatggctatttaggtttccaattttctgccattactaacagtgctgcaaggaacatttgtaagtatttctgttgactagattcctggaaggattctagcagtgtcaaagggtatgggaacatgtattttgtacacagttgatattgtaaagcagttgtgctcttgggtcacttacaattatagcataagtaatttctcatgttattaaatatttttgtaacttttaaaattaaatgcataatattcgttttcttaataaagtacttttcaaagaatatatagctccataaatctgtctgaatttcagatcatctccttagggcacataactgaaatgtatttgctgtcaaaaggcgtgatacatattatcaaattgctttcaggatatagtggggtttatcaaaaaggaaatagtttatatcaattatcactcttctggtagtgtattagtttgtgaactgcatagcactgatttactgttgctgtttaatttccattatcttgatgggtgaaaaataacgattagttctgattttaacttgctggaagattgattaaatttgaacatttcccagattcctctcctgtatcctcctatacctgtattctctcatacttaatctgttatcaagtcccgcagattccactttttttggtatgtgtagatacatcttttctccattttactcctgttgccttaggcgattcctttaacatatatttatgagacaagttctaactaatctccctagttccacgtcgacccccttctgtttgagtgccacgctgttgccagggtgatctgtctgaaagagttttggtgaagtcaccctacatactccccggtttaaaagtcttaaaaggcgcttagtgtttgtatatcaaagtctttgggatctgatctatgccttgccagtcttttcacttgcttttccctctcctatttgtgcttcatcataattaagaaaaaaaaatgtttatggatccctgggcagattagtctgtttcatttaaccatttggcctccaaccaatagaactgatcaactagtccctctttgatactatgcttacactccactcagagggtcatggcaagtataatgtatatttgcatttacatctttaataatgacattcggtgctcctgtaggaccataagcccattctgggcttattgattcttgtatgccagagccgaatattggacatggcaactaaaaaatgtttctaaaatgaatgtgtgaattcccaataatgtctttttttcatttatctctggagcccaaatatttccctgattttattgatttgcatacatttttatataatgaagatattatataaagaacttacataacctgtgttttgtttgtgttttaattgttgtttaatcttttgatctagtgaagttttttatgtttatatattcagatatagccatcttttatttgttgacatctcccactgatttgttgctgttaattttttttttttttttttttttttttttgagacggagttttgctctggtcgctgaggctggagtgcagtggcgtgatcttggctcacctccacctcctgggtacataaaagcgattttcctgcctcagcctcccgagtagctgggattacaggcacctgccaccacgcccagccaattttttgtatttttagtagagacggggtttcaccatgttgaccaggctggtctcgaactgctgacctcaggtgatacacccacctcagcctcccaaagtgctgggattacaggcgtgagccaccgcacccggccgattgctgtt

SEQ ID NO: 138374 - DNA, 1838 bp, Homo sapiens; identical to SEQ ID NO: 138373

SEQ ID NO: 138375 - DNA, 1838 bp, Homo sapiens; identical to SEQ ID NO: 138373

SEQ ID NO: 138376 - DNA, 1838 bp, Homo sapiens; identical to SEQ ID NO: 138373

SEQ ID NO: 138377 - DNA, 1838 bp, Homo sapiens; identical to SEQ ID NO: 138373

SEQ ID NO: 138378 - DNA, 2376 bp, Homo sapiens
acagaaaagctgtcagcataattgaattttctattaatagtttgcttttttctcttactatatcacgagcatttttccatgacagtagtcttctttttttttttttcagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaatcttgaactgattgatttttattatgttctgtcatatgggcacactgattgactttacaattccctcaa

SEQ ID NO: 138379 - DNA, 1621 bp, Homo sapiens
cttgcaccttctgctttccttcctgatacccccttccacagcccatttggtgcaggcattgtacttagagagggcaggtcgtgtagggggcgggtggggagtgctggtcttatagtctaagagagaaataagtgattactcaaagaagaaacataaaaggccacagccaagggccgggagtgggtagggggatgcagaccctcccctgtaactgaagatgggtaaactccaaccacaaggcgatgatgccacttgtgggccctcagattggagaggacggagatgagtgacaacgcgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttgg

SEQ ID NO: 138380 - DNA, 4076 bp, Homo sapiens
cccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaat

SEQ ID NO: 138381 - DNA, 4843 bp, Homo sapiens
gctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagag

SEQ ID NO: 138382 - DNA, 1064 bp, Homo sapiens
attgggactccccgaagtgcttttctgtccgctgagccttcagtttctgccttgttgcctgtgtctgcagatcttggggccggaggccagtccaacccttggagcaggaagaaacgcaaagttgtcaagaaccaagtaggtcataataagggtgatggcattatttgggggtggagcatggtggcgactgcaactcgaatgggcccgtggaccccttccatatccccctccttccctcttatctacaccatttcggagcttgcaaaagaaattgttctgcaagtacaagacagggaagaaaatagctgagaaggggtgggcgtcaagagagtccaggggttgggaggacgttactccaaattactgtttggggtacagggtccttggtgttggtccgtcgaccaagcactcacttctgaagtttgtcagtcttgaaggtttagtggaagcggaaaccgaggtgagggaggtaagaaattgctccggagcagaggtagttggtataatgacacggggtggggggggggggcggcggtgtcctggtacatttgagatggaggagttggcggaggcaagggcggagttggagacctttaggcatttcacgccagtacggcttttagatattctcacttcattttgttacaaggaaaatgttaacgatgaaaatgtgtggcgacatcttcggaggatgccaatgatgggagtaggggtggaggtggaatggagggttagaggaatcatcgaaggaggaagagggagggagataatgaattccaaagccgcagctctgtgaggagaggagggtaaccgaaggcgggaaacattgggcaaggcagttgtaaagggctaggaattcagaagagggatgtgtgccccgtcccgggtgagatctatatgtacccagagctctcagtacccctctccccgcgcccttggtctgcaggtttgcacgaagcagtgcacttggaagcaagaaagagaaggaaaaaaaactgcctggacctctgtgggtgcatgtgagggcgccactgttcacaggacatctggaagggcaggggtgg

SEQ ID NO: 138383 - DNA, 1936 bp, Homo sapiens
gaaaatttccaaacttagcttccgggtggaagaaaggaatcagtgatctagatatcaagccccgagtctctgccagtatctctgtatttttgtacgtttgtttgttttgttgttgtttcagtctgtttgcgttcaaagacacaaaaaggagcctgaaatctgaaatgcatcctttattcctaggtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttt

SEQ ID NO: 138384 - DNA, 1083 bp, Homo sapiens
aggacggaacaaaaataacaaagtattaagaaagtaaaaaccacactctcattccagattttcttttctgatcgcttgttcctttcagatctgggactagatttcagaggaaatggtagactttcatagctcgggggaggggaggtggagggagaggctgctgtcccaggagcctagggaaggaagaggcaatttttcataaaagtacaagtggcccatagccccaggggaagatgccgtccctttctggtaatcggtggaagggaaacacaactacaaggtgatgagattatcgaagaagaaagagtaataaggcctggtgtgggggagggaaaggaggggggcgggccctcttctgccgcactgctggtgggaggggaaattggggacccgagttggtggatgacgtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacggtgagctgcggggtgtttggggaagagctcagagactgggaaatgggaatctgctgggagcctagggccgcaatccggaaagggagctgtggcctgggtgttggcccctagtccaccaggacagtgccggaggggaatggctggatatgggggcgggggtggtgagatgcaacgcgatatgtcagcagaaccccaagagaggtaataggggtgggaaacctctgacaaccaggcctccgaattagaaaagagttttgtgttctggggactagtccgtccaccaagcgctcagtggcggcagtttcccgtctttctgcctgtggctgtgtcttactgaccatggctctgtgtctagtgggtcca

SEQ ID NO: 138385 - DNA, 2237 bp, Homo sapiens
cagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccagcacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaagtcgttctaatgcttgaatttaaaacccagatggagagataaggtacataaatacaaaagtatatatacaaagatctatgaaaaataataataataaataaatacaaaaggattactaacagtacctgggcatatgctctttgtcaaatatacactatctgtttaaatgaagcagaggttgctgagaaagcttcaaggaggaagggcgcatttaagctgaaccctgaaggacaacatagaagggcattccaggagggggaaatgctttggagaaaggcatgcaagtgagaaatctgtgcctgtgataggaaggtagccaatttgcttggaatggaagccatgggaagaggaatgatgagagataaatgtgaaaattcagagtgaggaaagtttgaggaagatcctgaaccccaagccaaaatattgaaataatatcttgtcatattatgcaa

SEQ ID NO: 138386 - DNA, 1249 bp, Homo sapiens
tgtgggaagtgggaggtagagcccatagcagagaaatcgtggaaaatctcgaccctgaacccgaaaaggcagacgttgaggcccctcttctgcaggctaacgctaggcctaggggctggggagcgaaagatgggtgatcctgggaggggaacactgaattgtttggcaggagtcccccataccgcgtcccatccagcttttgctgcaccctcgccccgctcccctcccgcttcgttgcaggagaaggggtgtggcggtgtgtcctggagaaatggcggacgggggcggggcaaagcggaaggagggattgagtgcctggggagcctgcgcaggaggaggattgaggtgggaggggtggggtgagaagagttgaaggaattgagaggtagaatcatttgacattctgatgtgcaaacacgaaaaggcagttactgagacccttgtcctggatgctgatccatccaccaggctttcattgtctaacgtcgacagtctatatttctgctcttcagtctgtccttaggatgaagctctaactgaactgaagtaaggagaaacagccttgaatctttggagggtcagtgctggggttggaattgtctggggccccctggtgtgggtgtggcagagacaagagtagagtatgggaccagaggctcctcctgcatcttctctcttttaatttcaaagacacccttgccccaggccctttctttttggtgcagagaaaggggcgtggcatctgccttagttaatatttgggggaggagaggctgaagaggaaaagaggatccctgaggggggaaaacctttgacccacaggggcccaaatcaggaaaagaaccagaattcgtccaccaatggctcaaaaacgccctttctgatctgtcctcaggtctgtcttccttttgggctctgtgcaactgcagctacagtggaaaaaagcaaactgctcttgatcccaggttggtatgtgcatgagcaccatgtaggggccttgggggtagggggtggggcatcatagcagaatctgagatctctactgtttttccagctctctaccagctttacccatgtctgtactgcctctcgtccttccatttagatgctggaagttgtaggcattggcagagcaggctaaggttgaagatgtagaaaacgttaaactaggtctgtgaatcagcaaacacaggccttgacacctgtgtctgggtgctagcccgccaacgaagcattgtgtccctaaact

SEQ ID NO: 138387 - DNA, 1051 bp, Homo sapiens
ggctgggccacaggtgagtccagcgtcgccgcatccccggaatgcggccgtgagaagcaacgcggggccaggtgatagaagcccctagaagactagcattctcgtgattatggaggcccttctgtccttctgtgacggaagcaatgcggacctcggtttcctggacccattctgactcaggagccttcatgtatatgggtcccgccatgcctcccagtaagatgccagaaagctcaggagttagtgtctccagtggactgagtcagtgttactggggcagtggtttctccaagccctttaggaagatgatgacctcgacttttctctgcctgacatcctattgaaagaggagaccatggaagatgaagagctgaccaacctgagctggctgcatgagagcaagaacttgctgaagagctttggggagtcgatcctcgagtgtcagcccggtccagggcctggacgatgacagccaccgtccccacccactctgatatgccctaggatgccaggcagaaccccaactgcaatccccccttactcctttagctgcctcatatttatggccatcgaggactctccaaccaagcgcctgcctgtgaaagatatttacaactggatcttgaaacattttccatattttgcaaatgcacctactgggtggaaatactcagtgagacacaatttgtcattgaataaggattttaagaaagtggacgaagagaggagtcagagtattgggaaagggtcgttgtggtgcatagacccagagtatagacaaaatctaactcaggctttgaaaaagacactttatctcccacacccacatccacacgtgttcaatacacctcccacctgtcctcaggcatatcaaagcacatcaggtctacccgtctggccgggcagtaccttcttcaagagaaatggagcccttctccaagatcctgacattgatgctaccagggccatgggactccccctgaaatacaagcaggttttcctccaggagtgatacaaaacggagcgcgggtcctgagctgagaggactgtt

SEQ ID NO: 138388 - DNA, 2044 bp, Homo sapiens
catgtcctcccttacccgcattatgttgcagaaaatgataggctttgggagagaggaaggaaacataggaacccagatgaaatatggaaataaatacttttcattttttccccagcctccgtggtttgtctaggcatttcgtccctactaacaccactactactaccttgtagggatgtttgagttgtctctgtataggaattgtcagactttgagaatagagcagaggggcttggagatttaggagtgggagaaaaaggggagatagaaaatgtttgccaaacaggtacttatatccagaaagaaactgtgccctaggtgctggtctctaccaaaaacagcctcaactgtctcctgtgtcttcatttattggtctctgtttttgtgaatccctgtaggtagatctgtccccaggtctgtggaactgtcagttgtgaagttttgtaaaatggtcacccaacttaaaactaggaaattacgaagaagagaaaattgccctgtatctgttaaggttggtgtaaaggtacagggacaggggggcaacttcgactagagaattccatctcttctgttttgtcattttaccaattattcccatctgccccaccccctgctgctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtaaggaggagaaagttactccagatcagtgcaggttggtatgagtgtggggattgcctgggtagacctgtaggatggagtagtggagagctgcttggctccagcaggggtcaagaaccactaaagggattcctcagcttctcatccagttttcctactccttatgctcctgtttggtgactggaaagaaggctgatggcacttggaagtgtagggagtgggtgaaatgaagggagagagagtttgctaattatctacctctctcacctagcactgaatcaccatattctcctgtctccctgtgctgatcagcatgaggagaaaaaagttggaagagactcaaagccccatttccttcctccacccctaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatg

SEQ ID NO: 138389 - DNA, 1075 bp, Homo sapiens
ttttcaggctacactgaaaatagacatctgttgggccaatttcaccatatagttcaccagaccaacctcagcctagttattcctgactacaggggactttaatttctgtgtacaacctttgaaactttgagatagaagaaggggatacattataagaaaacacagggtttggctcagcctcgaccaaaagagaagtctcagaaggaagctttgcttgaggcccataaaggacagtatagaggcaagtaaaactaaataggcaaaaacaagtccatgaccatggtgattgagacagacaagaggagaacaggcaagtgataggctggtgtgcaagttcatgagcatgcttgggggtggtgggtgggatttggaagaaaacagtgagtatgatgagtgagcacagttgcatctgtatcatggacttaatgcttatggattatttggctctgacatttagatttcagtggtaagtcagggttacacaggtgctagtgtaggcactgaggagtagaaagatgactgttgcaatttattgaactagaatcaattataggaggaaataaatagtgcttagcagtcagagtatcttatttcaatcttttatttgctcaaaggttttaaaaataataatctatttgatacatacccatacaaagctaacatatgaaaagcttaaagtagggcctttatcacttcaatacatactaaccaatacaagaccatgttttctaagagtactgacaacaaattgtccaacacacattttaaagtctcacacagtaaaatttgtcagcttttggtagaaccattcctctgtcagtaaatatcttggaataaagatcctagcacctgcagaattaccacagaagcttgtgcaaatgtgattttggacataattataaaacagtaaaggggattggtggctgtattggtgagatgagccctaaaatatttctcagagactgaagcacaggtaaagaaaggcaatgggaatagaattcatcaggatggtgagtgtattctgttcctactcctgctattgttaccaaccaacacagtgggtgggttcagtcgt

SEQ ID NO: 138390 - DNA, 1067 bp, Homo sapiens
cgtgggaggtgggtcgcgttcgctgctccgggccctgattccggaaaggggcctgtggggccccgtgtcctgggtgctgtcccttcccacagactccaggttgatgtcaaagtctgtctgcgcggtaggtctggcgtattctgacaggacacagtgagcatctgtagaggagaggcttgaaataaaggaggagcacgaatattccctggatttctggaggtgtgtggggatgtggggtgggtgccaaacactggagaaccgaatcggggtgggggactgcgaccagagcaggtcaggcatccaggagcacctcttaatcttcccctctctaatggtgttccaggcgcttcccccaccttccatccccatctgcctcccccaccgtcctaaactgggggcttgaaagggtgagctttggaggtaggggtgatgagggagacatactgacaagtaccaattcacgacctgttttctagaatatgtggcgcccttcccccattttctgctgcgcagagcaaggggatgtggcgcacctagtggtgaatcctcagaattggagaagggagtaatgagaagagtatgacgtcaagagaaggagttgttatctctagaaccttgaagcagggcctaaacaaaacgagaatattccaccagcaaaaccccgaatgttgaaagacagatatcaataatatggggattcttatccttagcgttggtctctctaccaagggctttactgccacccctcatttcctgtcttactttttcatctgtttgtccataggcctgctttaaggctggccagttctgcaagaaaggcaaggaggaggagactggctcacacctctggaggttggtgagaagggggagggggcaattcaggggacagttggagaaagagagcatggcaggtggctttgagaccagtgggtgcagacccacttctactctgctggatttgcacagtgccagcatcctttttatttcttgcaggggacatgagataggtgtaggttgtgttgtgactcagaaagacctgagagcagggaccaggacacaggaaacca

SEQ ID NO: 138391 - DNA, 1426 bp, Homo sapiens
gaggcagccggtccagagagactttctcaaagcccagctgtcccacctagcattcaacatcagtctcactgcatatgtctctgcatgggatgacataattggaagagactcaaagccccatttcattctctctccctagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcag

SEQ ID NO: 138392 - DNA, 2319 bp, Homo sapiens
agaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtt

SEQ ID NO: 138393 - DNA, 1021 bp, Homo sapiens
ccgagacccctggcgatggggaggcggtgaccggagcgggcctggccaagggctgaggggctggctcgggaggcaccgccagatcgtttggaggagaaccgcgctgaccgcttcccagccagctttgcaggcgcccgcgccccgccctcgacggtgtctgtgcccggagagggctgtgggggaggctcctgcgggagaaatggcggagcgggagccgctgtgggggcgcccgggaaggccgttggggggcgcccggcgaggccggcgggggtcggcgtcccggctctgtacccagtccgccggaggtgagccgcgtttgctactccgggtcccgattcccgaaaggggcctgtggggccccatgtcctcggtgccttcccttcccacaggctccaggttgatgtcaaagtcttgtgtctgtgcggtaggtctggcgtattctgacaggacacagtgagcgtctgtagaggagaggcttgaaataaaggagcacgaatattgcctggatttctggaggtgtgtggggatgggggttgggcgctaaacactgattggggacccgaatcggggtaggggactgtgaccagagcaagtcaggcatccaggagcacctcctaatcttcacctctctaatggcgctccccccaccttccatccccacctgtctcccccaccgtcctaaactgggggcatgaaagggtgggctttggaggtgggggtgatgagggagacatactgacaagtactaattcacaacctgttttctagaatatgcggcgcccttcccccattttatgctgcgcagagcaaggggatgtggcgcacctagtggtgaatcctcagaattggagaagggagtaatgggaagaatatgacgtcaagagaaggagttgttatctctggaaccttgaagcagggcccaaataaaacgagaatattccaccagcaaaaccccgaatgttgaaagacagataccaataatatggggactcttatccttggcgttggcctgtctaccaag

SEQ ID NO: 138394 - DNA, 1006 bp, Homo sapiens
ccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggcataagtgacccttcttcagtttaagaaccatgtacagataaatcgtgtgcacttacaaacataggtaattattagtatgacaaacatgcgcttattagaaaattctgttcttgagttaagaagggagagattattgtgggccctgatacttgaggaatgtttccgagaagagggacccacttaaattggtcaggatagaacaaattggtcaggataggagagcaagacaacttgcccgcctgcttgcccaattatgagccttcccaacaagcaacctaaaattaatacttcttataggacccatttaaattaccatcttagccct

SEQ ID NO: 138395 - DNA, 1035 bp, Homo sapiens
ggttcctctacccacaatacttctggcacagaatgtgtggatttttcacaccaagcaattctcttattctttgaggacatcagctaggtattctacaatttaattcaattctgatactacccagagttagtgcagacctctctggttaagggctcattcccataagactgccctccctcacttcagacaacagtcacaagtaatggatctccatgtcacccacacttctgtctgacttagctactagttggaagttcccacaaccccctcctcaggttcaataatttgctataagggcccacagaactcagggaaacactacttcctattactggttcattataaaggatataaatcaaaagccagatgaagaggtacatatggcaaggtccagaagggtcccaaatgcagaagctgccatccatgtggatttggggtacaccaccttcccagaatatgaatgagttcaccaacctggaacctctcagacatttgggatttttatagaggtttcattacataggcgtgattgatgaaatcattgaccattggtgattagctcaatcttcagcccctctcttctccttggaggtcaaggggtgaggctgaaagttccaaccctctaatcatgccttggtctttctggtgaccatccatatcttgaagctatctagtgcacccaccagtcatctcggaacataaaaaaagacacctatcactccagagattccaagggtcttagtgtcaagaacttgagactaaagccacatgtaacaaaagatgcttccgttatccctatcaggaaatagcaagggttctaggagctctatgccaggaatatgggacaaagaattatggttaccaaaggctggaaagggtattggggatggggtataaaaaggagttggttaatgggtacaacaatacagttagaaggaatatgatctagtgttcagtagcacaatagggtgcctatagttaacaatagttattatatatttcagtataattagaagaatagatttggaatgtcct

SEQ ID NO: 138396 - DNA, 2862 bp, Homo sapiens
gggtccaaagagactgggcactcctttagcctttctcactctcagcaagcttacctgccatctttgttcctgtttgatgcagagtaaaagaatgacagtgcttgggcaggacattgttgagcattagtggcagtgtgcaaggtataaaattaagtagcagagttttttattaatccacttctacacaattcatttctactctcctatgtccttctgtgtggctgtttgcatagagaagcacagttagacaagactcaaagccagtttctttcttcaacctcaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagtta

SEQ ID NO: 138397 - DNA, 1051 bp, Homo sapiens
tgagcagctgggactacaggtgcatgccaccacatccgactaatttttttttttattttttgtatttttagtagagacagggtttcaccatgttggccaggctggtcttgaactcctggtctcaagtgatctacccatcttggtctccctgagtgccaggattacaggcgtgagccaccatgcccagcctcccccaaagcttcttaatgcccttttgtaatccctccctcccctctctccctgtgcccctaacccaggcaaccatgggacattttctgacaaaatagaattgttttcatttcctgtaattgtgtataaatggactcatatagcatgtactctttggtcgggaggggatctggcttatttcacttagtgtaattatttgagattcatccatatcatgtgtctcactatttcattgctttttattgccaagtagtattccaccatatggctttaccacagtttatttatccattcacttattgatggacatttgggctgttcagagtttggccattataagtaaagcagctatgagcatttgtgtacaagtgtttttatggacataggctttcatatctttggaatgacatctaacaatattgaatcttcgacccatgaataaaatctctctccacttatttaagtctcctttatttctctaagcagcattgtgtagttttcctgcaacatgcttttttagcagctgcatatattctgttatgtggtggtattacatgttatttaatctgttccctgatgatgaacacttacaggatttggtaagcatgaataattctatgatttggtatttaaatcttattctataggtgaggaagaccaaagttgtgatgggtaaagaagcagcagtcactaatattagccagaatgggggggggggtatttcatcatttttataattgggacaatgattttctgtgttaatacatgattacagagtagtcttgcttttgtcttgatacatgacattcatggagtagcctggtctgatgttaatgttctgtgaaattgtttcaattcaatg

SEQ ID NO: 138398 - DNA, 1002 bp, Homo sapiens
tttgaagaaagtcctatgatgcctacaacaaaaatagtaacaaaatatagtatatgtcataattctcacatggaatctaatcatgaccaatcacgtgaaaaatcatcattgcacgtcaactgtcagagctctgataaccaacatttaaaaatctcacttcctaataaaaattcttatttattgatctacctgcaccataaaacaactcaacatgaagaaatttcggtttcttcagactgagtttgcctagctttacaaatcattacagggcttttcctagctatacactgtacctcagacacagtaactgtgttttcctctatcacacacatctgctgaaatgtaagctatggctgaatcatttaatatctgcctgctaatggatatctatattctttatctgtttattcatgtaggctgaggtctgtacctttctagaaacctgaaacattggaattattcttttattcacagtaatagctatagcattcataggctatgtcttaccatgaagagaaacaacaatcacaaatttactatcaactattccatacgttggcaccaacctgttagaatgaatctgaggtggattttctcttgacaaggcaacttcacacaattcttcacctctcattttattctgccattcattgtttcagctctaattattgtgcaccttttattcccacatgaaacaggatcaaataacccaaggaatctcaaccaactcaaataaaatcccattccactcctatcacaaaattaaaggcattttaggatttatttttctactatcacttctactcaaacttgttttattctcccctgactttttaggaaacccagattatattccagcaaatcccctcaatataccacctcatattaaaccagagtgatatcttctatttgcctgtgtaatttaggatctactcccaataaactaggaggtgtcatagcccttgtgctcttaatcataattttagcaatcatcccaatcct

SEQ ID NO: 138399 - DNA, 1404 bp, Homo sapiens
tacttggaaatgtaacatcaagcaggaataagcccacatttccattatgtgtgagcttcagtgtcactgctgtgtgtgggaggggttctgggatggagttgaggaagaggaaaaacatcactgctcagcttccagttaactgagtggggataggccagacatcatcaccccatcccctgcatttcatgtgctttcttatcctcttactttcttctctattccatgtgctttcttatccccttactctctcttctagtttaacatcagagactctgaaagcctcttaggttactggagcaagaggaaagagacccaagtcacatcatggggacactttaggcagggcatacctttctgccagttttgtctatccaatgggataataatacccacgcctctagaccacccaggaatactctggaatttaagtgtgatcccatgtggcaatctgcggtcttatgtggtggggaagaaccagtgaactttcagctaagtatattaacagagcaaatgcagatatcccagaactttgtatggtgggcattaaatttatggtacccaactctgagctgtttaggtcaggatttttacaagtgtgatctatggaccacttcatcagatttgtccacagttgcttgctaaaattgcacatacttgaggccatcctagatctgcagaatcaaaaccagggaggtgaagtgagaggtgtctagattttgagtaatttcttttgttgtttctgttactcatccacaattgaaaagcaatgctatggatggcaacaaggtctataaaaagtttaaatcctttgatgtctaatttcattgttagttgctcctgctactcagctttaaatttctgtgtcttctcttgtgtgtccagtaggtaacaattttttcaatacaataattcttattcagtgatttatgtatgagacactgaagaaacatcatagagaataaaagaagaatccctggagctattgttctagtttggggaaactggcaataagcaggtaaacaaatcaatgagtgaggcaatttcatatggggatttgtgttttgaagaaaatgaacaggtagagtagaaaatgactgagacagggattattatagatggggttgtcagtgaagctctttctcaggaagtgatgcttgagctgagtcctgaacaacagaaagaagccaggcatggaaaggccattttgtcagtgtccctgtgctgtgtgtgggcaccattgatctaggagcagaggacaagttgaagtggctgaagcctggcacgtaagtgcagacaggtgggagatgaggttgaaagggcagacaagagccacatggtttggatcctttaaggagtttgggttttattctgagtgtggaaggctagagtacaggagtgacgtga

SEQ ID NO: 138400 - DNA, 1047 bp, Homo sapiens
ctcatcagtaaagtttaggttggggtgttcacagtgtagaggagtccctcccagagagcagagtggttatccttcattaccccaacctgtacaggcttttcagaccttcgcctacccctcttagtctccaggatactgtgaacatagcagcccagaccccattccgctgcccctctcctctgtcagtcacctcctgctggccctgccccacgttatgccttccagccagtgactatcaaggggcagtagagctacctggtgttccatcatatggatgccccagagtatgttgttgttgttgttgttgttttacagtcctcttgcacttttaagtttttttcaggcagaatttgaatcattcgaatggttccataaaggttaataagctaggtttttaggaaggtattgtattttttggtttttgtatacacttctttgcaaaaaagtttgatagtggaggtgcattggtgccaccttgtaacagaagcctgaactgcagcctgaactgcagcctgaactagtgtaagctggaaggtgaaagggagggactgtggtccaaacttacaagatagaactttctggaagtctgggcgtaaaaggtggcatacacaggcaaaaaaagatactgaaggcctctaagcaggaagtacaggtttttagtatgttaaagagaaagaggtatgtgagaggaactaaaagatcattttaatgtttatgtgttgagacttgtggttaaatagctagaagcctatataagcaaaaatgggatcagaccatttatgatttttgtaatccactttcactgttattgtgattacctttctgtgtaaatatatttttatgataacatttgaaataactacaacaaaattttagtgtcatttttttagtggcctgggtatcatctcatcatgtggatgccctaaaatttatttaattggtatcctaattacaaaaatttagttcccttactatttttttctattacaaacaatagtatacttaacactatgctcatatagatgcaaatgtctttgtgagcattta

SEQ ID NO: 138401 - DNA, 1093 bp, Homo sapiens
ctaccagcacacttccttttgcttcaggggatgtcagtctttttttttctatgcagacttccagttgattagatgaggcctacccacagtatagatggtaatctgctttacacaatatccagaaatttaaattttaatctcattcaaaaacaccaaagaaacatccagaataatgtttgatgagctatctgtgtactttagcccagccaagttgacatataaatataaccatcacacactaaaatattattcattatttatctggaattaaatttaactgagtgtcttctattttatctggctaccctacccatggaggactctgtgtcaaaccaaagtgttccaggcaaaaccccagctttgctggagataccagtaccagtcatcatccatgtgagtgagcctcttggatgtcccagatgtgtggagcatccatatgactgcatccccaggtgacagataccccatgaagcagaaaacgcccagctcagcccagtcaacacacagaatcctgagcgataatagatggctattttgggggacaatggttaaggagaaatatatatgcaaaacattagggttttggtgagctttccctctttttctgtgatctgttactgaataagaaagagattctcttatccttgaaggcttggtggaacttagttataattttgactataatctgagtgttggtttatatgtggatagagatttgtggacatatcattgattcctacttgaagagatttccaatggaaattttcacaatgtataaattttccactactattggaatttggagcctaataccgtaagatgagcctctactacagtcacgtaaattaaggtgttgagagtgtgttgctacaaaccacttcatactatgcagccataaaaaatgagttcatgtcctttgtagggacatggatgaagctggaaaccatcattctcagcaaactatcgcaaggacaaaaaaccaaacaccgcatgttctcacttatacgtgggaattgaacaatgaaaacacatggacacaggaaggggaacatcacacaccggggactgttgtggggtggggggaggggggagg

SEQ ID NO: 138402 - DNA, 1523 bp, Homo sapiens
gttccgctgcagcagccccccctccccacaccccagcccttctgcaggtctgcggggccaagtgtcccggcggcgcacctcgtggcgagaatcgggagaaggaggagactacaaggataggcccaggtcagtgcgagggacggtggtgggggcgggtgcagagtccagtctgaggtcccctcccaactcccccatctcccgtcctccattttggtgcctgccgagatctagggatggatctgtagggaaaatggtgggtttgggggcaggtaggggaagacacgagaggtgggggggggggcgggctcgaatgggggccccctagtgggcgcacgaaacctctctggtgggaaacgtgaaattaaacaaaacaaaacatgttgatagccatgacgcggaatcctgaaaaatgagtagccgtgcctctgtcctcggtactgaagcgttcaccagctgttcagccccttctctctccttttgtctcctaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgtttacgtgggtctcctattaccagcttctaattgaatattgtgtttttgaaccagtctgtaagatttttgttagcagaagaattttacctattgcatggaaagatgctcattatagtgaagttaataaagcacctttaaaaagcaatctctatattctttttttgttaaaaatttatattgattgtacttaatacatgaaaagaaaagtactgaaattaaatataccaaaggattaatatagggactcattctatgagatgggttaatgtattttttatattttctgtaatttaagaaaaattggaaacatttttaaataacctttgaaggcagtagagtcacttaataaatacttgctgatcagcactactcacaaaagcaaagacatggaatcaacataaatgtccatcagtgagagactggataaagtaaatatacatatacatcatggaatattatgcagccataaaaataaagaaatcatgtctgttgtgggaatatggatagagctggaggctattatccttagcaaactaatgcaggaacagaaa

SEQ ID NO: 138403 - DNA, 1418 bp, Homo sapiens
agtctgcaggtctgcggggctaagtgtcgcggcggcgcacctcgcgtcaagaatccggaggaggagactgcaaggataggcccaggtcggtgcgagggtcggtggtgaggcgggggccggaacgtgaggaaagcccagtctgagaccctaatccatgccttcaccctcgcccccctctaccccatgcaaccctccccttcccacacgccatcctcgtcctccattttgctgcctgcggaagcctggagatggatctacagggaaaatggtgggctttgcggaagggaggggctcggattgagggcaccccacagggcatactggcttctcaggtggaaaaaaatgaaatgttagagtataaagtcaagtccagggctctgaattttaaaaggtgcctagtagggcctctgtcctcagtgcttatcagtccaccaagaattcagcccattttctctctcttgtctcctaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatca

SEQ ID NO: 138404 - DNA, 2672 bp, Homo sapiens
atctaccacctttgcccatttcaatgctggataggattccaggggaaatggtggactgtaggggtcttggaggaggggaggtgggagtattgggagcagaagaaagagatgattcctcaaagaaggagaaatggtcgattacccctaaaaggctgatcctcctggtaatctgagaaaggcgaataaatactccagggcgaagataacagtttattgtctccgattggcaaatacgaaaaaagattgacagtatcaagtggagggaacgcagcgggcgggctgcagtgttaatgggaggggtaactggggactcgagctcagtgatgacgcgactctcacgtgaccaggagtcgacgtgtgcagaagtccttatagtccagggcctgtttccctgtagcagctccttattgctggagaaggagaaaagtgcccaagatcctttcaggttagtataaacgtgggcgctgacttggagaccctggggtcgaggaggccgagagcagaaagcaagcggggccggcactgctttccccacttctgttccgccaaactcccattttgtgcaggaaatttggggctgtttggtgggggatggcgggtggagagagagaagggtagctaattaagggtcctgagagagagacatagaaactgtttggaagaaacttgcttttcctactccctgcttgcagaaaaacggtgggcacggaggagggcggggttgccataaaaggagggcgaggatgaggacatgggaaactttacaccaacatggcctagaatcatgaaagggacccgtgatccaggtactagtctgctcaccaaacactcccatctgtctgcaggatatttggttttttgggcgcgacacaaatcgaggtgagggaagagagaggaaaatcccctgaatccctgcaggtcagtttttgtaaaggtgcaattgcttcaggtctcttcgggtgggggtggaagtgtgagtgacaccaaagcacatcctggggtcgcagcagcccctccccatccggattaagtgccagaggccggtgccgagcctgcagcggaaatgaggcgggggaggaggaggcttaagagacgctgaagggggaggggaggccagagactggaccagccgtctcaggtgagaggctggaggttgagagggcctgggaaagtctgaagggcgggagtgttggagaccagaggcgggagaagggttaattgcttccgtactgctcccatttcagtattaggagaggcttgtagcagggcctgctgggaagatggtgggcaggagcaggaggagaaagatggagctggaacgaaagggggcgcgaagggaggtggagtcaggggagttctgagcctgaggatccagctttctctagttggaaaacttttgacaattagggtactgagtcaaaaaaggccagtcgctatgggaccccatactctgactgctggtctgtttgcctggaatctagtagttttgtttccttgttttctaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagatacacacgtttaagactcagtcttttcatggggaaaatatttgcttcacagggctgcagtggggaagaaatgaggcagtaacagctgtgctcagtgagatcttgttcccacctgtgcatacggaatcccaacccactatagaagca

SEQ ID NO: 138405 - DNA, 1044 bp, Homo sapiens
gtccaggactggattctctccactcctttcccgatgctcactcatttggtgcaagaaatggagggcttggtgcggggcggggaggggggaggggggcggaactcgagagaggtcaagggttgagaattgggtaccagttgggaactcctaggaagccggcgaccgggtgatgtctgatggaggaggaggaggaccagggaagagaacagcgacgaaacggcgagaaaacggcctgatccctgcaaggcagcgggaggcgggcacagtcagtgaccccaggctgctgagggcggaccctgcaacgggtccaggcctgagttccctgtgtcttttctccaacctccctccattttggagccggaaacggtgggctaagggggtcaggggaaggaggtgctgtagaaaaagggagacagaggtttgatctggggatcagctccctatccaggaggagtggcttctgaagtaggaggattgagatgaggtagcagcaagaccaaaaatgttaccgggtttggaaataatttgtctcttgcattgcagaaaaatgtgggctttctgtgtatgtggggagggaggaggtggcaggagtgttttggacatttctgccctgccccctatctctgtcatcaccattttcagagaagtggtgggctctgctatttggctaccctagggtgagggatttggaatgtagagatctgagtgcatcagaacactctgtcttcagaacatccttgtctctaaccctactcattttcgtgccagaaaagtgagataaaaatttgggaggaagattcagaaacatagaaacgctttggaaataatctttctcgcctatttcccacaagtagaacaatggaggctcttaagaaagagctgcgcgcggagggggaatcagagaatgcaagggaaaaggcgaggaggtgataggagctcggaaagttttgacaaatacggtcccaaagaaccagtgtccaagttaccagtcattcactttctcaatttctcattcacccacctgtttcttgtctttctgcaggt

SEQ ID NO: 138406 - DNA, 1608 bp, Homo sapiens
tccgctgcagcagcccccactcttcccaccccggccgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttcacccccacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagcattctctgcattcttttttactttaaatcttaaacatgcacctaaacagtcatatatatatatatatatatatatatatatatatatatatatacacacacacacatatatatagtaaatagtgtttatctctgtggtagaattaagagggagtttattcttgcttacccataatttcttatttttcaaaatggaacacgtattactgataaaaagcaatgtgaccaccttataaaagcgatgtgagcacttactaaacacttgtgacagaatctcaattttagcttgcctctgggttctctttttagaaatgtaagagacacatctctttgaagataataatatttatcagtaagatgaagacaatcacctcccaggcttgttgtatggaccagataaggtaatgaggttgtgagctttctcccaagttcttgttcttactgacatgcatgacccaacactttagatattcccttc

SEQ ID NO: 138407 - DNA, 2359 bp, Homo sapiens
actgacagggccaaatgtataagtggggggcggggagggagagagggtgggcccacttctgccgcgcttttggtgggagtggaaattagggacccgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcaggttggtgtcactgtaggtgttgactggggatttctagtgtgggggggtttaaggcagagacttgtgggagtgccggtcaggtccgtccctccaccctccacctccaggtctacgggaactgatgacccttgggaaagggactaggggtcctaggagaagaacagggagacctgtggtagtttaaaaataatcatcctctgctatctaagactgctttccggacccccaccctcctcccgaaccccgcctcagtcttaaagatagtttggaaataatctgctttctcactctttgtctgatgggaaaaacgaactgacttgcatgcactgtggagagggggtgaactaggggaaacaaaaggtgggaaactttccatatccgaaaccctaaaggaggaaagctacgtgtgtcagtctctggcgctggtcggcccaccaagcgctcgccccacccccaccgtcccctcccgtttccagtttatctgcagggctgttgtttccagcaagacccaaagctagaaaaggaggaggaagaaactgacccgatcagtgccaggtaggtgagaggaatattataaagtctcctggggtggagacaaaggttgtaagcgccaccgttcctgccggctcccttccaccccacccctttcccctcttcttttctctcccccttctcctttcccctcttcctctgcctgccagccacctttctcttttctggcctggtccctgtgttaggccctatgggggaaaaaggtctggggagggctggacggcggaaaggagggccttggaaaaggttagagggaaggacaagagagaagtgaggaggtggaaagtggaggtaaaaggagtggggatagtgaagctctgattgctgactgggcttcttaggtggaagatattttataacagctctgaataaaaaaaattaaatgctaaggcctctgtccacagcacctgtccactcaccaagtctttaacttactgtcttctttttgctttctagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaagcaacaagcagcacgtattagtttatttctaaaagtattggggcatttaatatttgttgacagaattttagaagaaatgtgaacttgaaagtaactccagaccacttagctagaataataaattttacatattttctcatctttaaaataaagaaaataatctcacaaggatctggtgagggccaaatagagtaatgactgtgagctatgtttgacagagttttgttcccatcccaactccgtaaga

SEQ ID NO: 138408 - DNA, 1822 bp, Homo sapiens
gtgcagtcgtcactcgcgtctggctaccagctccccgctgccctgagctcggcgggctggcattcggcccggggaaaagcggagcaggtaagggctccggggcccgtgagccccggccatgccagcagcggctgaccgacctcggcgacaggcgcagaacagcgcagggggtccccgccagctttctccacaccccaacatgcttgggaacacagaggcccccagggatggggaagcaggggcggctgggtttccaggggcggcagagccaccaagagcgatggaaacccacccccgagtccctgcaggaaaacagcgaacaccgcggggggctgggcgttcgagggtggggtgggggtggggggcgggagacgcggggcgctggcagcgaggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggtcggtgcgagggacggtggtggggcgggggtcggaacgtaaggaaagcccagtctgagaccccaaccccctccaccccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatctatacatttattgtctcattaaaaatgtatacttacatataacagatgaactaaaaaaaaatctgagattaaatacactagagtgttaattggtgaacatttctgtgtgttaactaatcccagcactttgggaggctaaggtaggcagatcacgaggtcaggagatcgagaccatcctggctaacacggtgaaaccctgtctctactgaaaaaaaaatacaaaaaattagccggtcgtgatggcacacgcctgtaatcccagctactcgggag

SEQ ID NO: 138409 - DNA, 1063 bp, Homo sapiens
tagaaaaatagccctttctggttttctttcataactccttcaaataactcagacaagagtgcactgcggcctaactgagaaaatgcatctgagtgtgccctgaattgcattactgcaaacctccacaatacaaacaggctgaaggctttatttgtgcctgtgtttctatccttgatacggattttctcaaaggagactcttggcaggcctgcccacccagtttaacagacttacctagacatgtaaattacattgggagaacaaattttctttaaagcggaaacacactcccttcttgtccatacctgaaccatgaaactactctgtaagttcttaaaaactatattaagtatttggcattgttatttctttgtgagtgtgtgcccttttctccagacagtttctggtatagtgcccgacatagtagatattaaattattaattattttgattgattaattaactaagagttagaaatccagctcaaaactgtccctaactcactatccttaactaaggggccaaaggcaagtaactagttatgtggaaagcattatattatttccaaaggaacatagcaaggaaagtttctaactcaaattctgtaaacttttttttaaaccttgtatatgttagtgtttagggaaacatagacgccttacgtgcatcataattacctagggaaagtgttaaaaatgttgacagttgggtgctcgtcccacccccaaccagccactgtgaccacctgaatcaccagaatcaggaattactattttgacagtttcccaagtgattctcatgcatctgagttttgacaacataggcatagagaaacactgacagtaattacaccattttacaaatttcgtgatccaaattaccttacttacttgattccacaatgcatatacgtttccaaagtacagcattccaaaattagacattaggccatcaatgtatgtttatacttaaaccagtactgttttatcttcttttcaaatatcctattaaactaatgctttatcatgaatttattattaataataaatgtaataattatgaa

SEQ ID NO: 138410 - DNA, 1040 bp, Homo sapiens
tgtttttagcaatatgggaacagactaatagagtctaggtcttttacatgtccatatgaatgttagaatcagcctgtcggtttctttaaaaattttttaataggatttccatttgaattgctctgaatctatagatcagttttggaagaattgacatcttaacaatactgaatcttctcagtattgtttgtgacccatgagcatggtaagtcctccacttatttaggtctttaattctctcagcaatgatgtgtggtgttcagtgtacaggcactgcacatctgtggacagattgttcataaatatttcatactcttgatgatgctatacatggctttgtttgttaaacacaattgctaattactatattttcacagtactatcagcaaccaagtgtttaacatcagtgaggcatttttttggttgaaagcacagcttactctaggatggaaaaggtatttgatccttaacctgtgtttacctgtatttccgtatctgcttttacaagtcattggcgatatattgaaactatggaggaaaatgttccagagacaattctacaggtcatcttcagaaatcacaccaaaagaacatagtttagtagctttcaactttatatgtgtggtcagaaatgattttgttgcaatgtgtggctcaggctggagtgcaatggtgcaatcatagctcactgcagccttgaactcccaggctcaagcaatcctctcacctcagcctcctgaataactgactacaggtgtgtgcccccatgctcagctaaacttaaaaacatttttcagagacagagttttgctatgttgtttagacttctctcacactcctaacctcaagcaatcctcctacctcagccatctgagtagctgggattatagccacgagccaccatgcctggcgagatttacttctttacccaccagtaaatcaacctcaataaattcttggaatttggagtggtgagagggtgagcaagcatatatgtatgtgagtatgtatacatttgtatgtcactgaagctgtcagga

SEQ ID NO: 138411 - DNA, 4419 bp, Homo sapiens
ggctgatatttatctgtctagatatttccatgcatatttatagacatctgtttaaaacacacacacaaatgacagcacactcttcctaaaaactatttcacactaatgcttatttctctacctgtactatctttttttttttggagatggagtctctgtcgcccaggctagagtgcagtggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaagtaatttgtagtgtgcctttcatgttactggttggtattctggttattgtagaaataaggttggtattctgtggttattgtagaaattttagaaaacatagtaagaacaaatgcaaataagaatcatgtaattctactggatccttcaaggtcccagcaaataaatgggactcaaaaatgggtgatttgaggagagttaaagaattttttccctgagttgccaccagaggggtagggttgtagtgtatattag

SEQ ID NO: 138412 - DNA, 1050 bp, Homo sapiens
tttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaagaaaaaaaaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaaaagtcgctctcctttttttttcaaaaagatgtttttccagtgttcttgaagtcatgaaaaaatgaacttttatatttttgttaggagtacaaattaa

SEQ ID NO: 138413 - DNA, 3223 bp, Homo sapiens
tagacacttcctctcccagtggggggggaaaaaaaccacaaacccataatgcctccctgcaggaaaaaaaaaaaaaaggaaaaggaaaaaaaaaaaccctctggtcagaggaactctgggtcgtgaaataggccacgtgaacattctgccctgtagacttatgacccaacggctgtcacgcttttggagggcgggctaaaaaaaaaaacctaagagggcgaacgtcattggccggaactcgtactaacggaggaagaggattggtttgctgtagaccttaacagtgaagaagcaggttgctagcacccgcctttactgcggcgaagtgtcattgctgacgtgggggtggttgtccaatcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaaaaaaaaatctattacatgtaatggaaatgtttcaagatccagaagagaaaattgatatgaatgtaactgatatggtatatgtgcatttaaaggtttattccaacaaaatgttactcacactcttttctgacacatgcatacacaaaagatgttagcatttgcagtctgattcccaaatggcccattgcttgtgtggagagatgaagtaggatttgaaggtttttcagccttttgacagctacatatggagtcactgtaatttccttttttttctctcttctgaaaagtaggtttcggaggagggcactgccctcctggaagagatgca

SEQ ID NO: 138414 - DNA, 1006 bp, Homo sapiens
ggataggcggaaatgagctaaggttcccgcgagtggggaagcgcgaggtcaaatctggggccacgcccccagtcctgtggcgcaactccccgaacacggaaaaaaaaggcgcagtgggggttctgctgtgtttgcaagtgagggtcgtgagtgcaacgggcgcaaggcattaaggccagtgtgttagtgcgcgggcaggctcgcgtggtgctggggttgctgtgtgagcggccctcgtggctcgggaggtgctgtgtttgcgcaggcgtgcgcccctggcgtcgggactggtgagagccacggcgggcgcgcgcgcgtgcgtgatggtgggggcggtgcagggaggggtttgctactgcgcgcaggttgttatctatttctgtgttatatttgaaaatgttctaatgaaaaggaaaataaataattaaggaaaggcgacaataacagataaaggggcactgtcagaaatattttggctttccgtactgatttaattactttaaaaatacacttcctacgttttcctccgtgccaaaatcctatcgtaaaccacagccctccaatgattcagagccaaacccttccatcgccgcattagcaactccaaagggaggcttctttcaagttctctagtatcgtcctccctcccctcctccacacctaccccctcccttcaaggttgcgtgcagttctcttggcacaaatacaattttcctgtgagaatatctatctacgacagccttcccctccgttagggactccggatttctgtggcgactgaggcgctcttacctttgcgtcctgatctccaagcaagcacactgaccttcttcaggcaaatacgcactgttaattttccagaaagttctgtgagtaaggtttatacctctcgagtctgccactagatgccgccaaatcccagcaaaggattggctgtttggtccctgggattctgggattttgtttccctcccccctcccctttctgatttgctgaacggtaatat

SEQ ID NO: 138415 - DNA, 1986 bp, Homo sapiens
atcagggtggtgaggaaacagttattgaaaacctgttatgggccacacactctatacacccattaatctcaacaataggcctgcaaattgggtgatatcatcattattttatagataatgaaagtgaattctgcagtgtgtaattacttatctttggtcatataacttgtaaatagtggaacctggataattcctggcatatctgcccatattattttactaagctttctactttttggctttgaagctggtttagttatttacttgttaagtgactttaagttatttaacttttctaagcctcagtgtcacatattaaatgggaacaaatatttctatttcataatcttagagccacactatccaatactgtagccattagtcatatgtgactatttaaatttaaatgcagtaaaatttaaaaatttagatcctcagttgcactagtctcattccaggagctcgatagctacttacagttagtggctaccatattagacagtgcagatacagaacatttccaccaccacagaaagttctactggacagtgctgatttagaggatataaggtatataaaagggcctaacacggtgcatatctcatggcagatgcccgagaaaagtgatctcgtctgcttttttctttcagcatcagagctaggggtgttctcctgttttattgatggagttgggagagggaagtaacttacccaaggtagtgtgataggggatatatctggcaccgggacccacatctcctaactcttgctctaacattctgtctagtatacccatcattatgctttactctactgagtgaggtttcaaggccaagcatgtgaacagtgtgaattaactttggaatcagggtggtagcagaaaaaggcataggaactgaatgtctcctgtgtgccacatagcactgtgcccagctttttacatctggtatcttagcaaatcctcagtgaagcccagagaataaataccccaagttgctcagcaagtaaatggcagaccaagcccaggctttttcccattatgtcatgctactccctcaaatgtgaatactcccctgccacctccacttactagtgggtcctcagaaaatgggaattactcctcttttgaatgtatagctgaaccgctgtcttcacagtctgtttcaactggaatggaaaaatagcttaggtcaatgtttgtttggctccaaggccagacagagaatatttatggtcccagccttcaaaggacaggcaatgctctgagaaccctgtgttaattttcaaggccaccattagctcataccttgcttttgtgctaattagaaaagcatgtcacctggggggcagagaaattgtagagaagggcccattccagtggaacaatgagaaaaataacttttctttctgtaggctgttgcaacctcaccagaacagctgaagaatgaatttcagcctggactctaccttattagttgggcacccttggggagggtgcaacctgcccaacattttctgctggccctgtcttacctcatgactaagagagccttcctaggtctggaaggtagcagtcagtctgttctggagggtggagagagacaccagtgttttcccatggtttctgggtagtagataaaattggtctattctaaggttaatttgatattttaaaattttgattctgactagcttattggatttttttgaataatgtttgattaatgtaaaggttaaaaataaaacctaatatttcagctaagcaaatggtatttctttaataaggacgtatttctatctatttatacctgcctcattccataggaattttataaagccagtccaggaatgtagtctgaatcaatctagtttgctagcctgtgagaccagggcaaagatgaaaatagtcatgggaaagttttatccttttaggggtatctgtcttcttctagttcctctctcctcctttgacaaatccccaccccg

SEQ ID NO: 138416 - DNA, 1034 bp, Homo sapiens
tttagcatacaatttaccaaaatttgtagtttcctgagccacagacttcacttggaatgatcatataaagtcatccatgctacataccaacccacagaaatgaggaccgctttcctccagtgtatgctgagtcctacaatctgagcactgcttcaagaggatgccttgagtcatttttccagagttaaatttgcttatgcttctaacctccacctacagtccccgttacactgggaatgataaaaactatgccttttgaaaatataagctgtcatgttattaaagatgacaaaccagtagtagttaaagtgctgcatctaaattgttgaagcttgttacgtgggagttcattagactgtttttcctacttttgtgtatttttgaagttttccataataaaacatttaaaaagacaaaaaatgttttaaagtgcttcatcagtcctgaggaagagaacgcacatgggtttctctttagaagagtacttattaaccaaggggttaggtagaatgtacaccctttagtagagacataccctgtaaaaatctggggaggggggcgttttagattgaaaaagcctctttgccaaaaattctggttaggtcttctagaagggaaatatccttctgcctgcaatccccctccaccaaaccccacaagtaagtcttgctgtaatgaaccactattggtgaaagaagtatatcatatcccttgggcgattgagagtggagggagcttgaaaaccatggaaacagacctcagctaattggcaaaaactgttagccagcaggaagagaagcacaggcaaagggagtattggggcaggagatggaacttggagtgtaatggggcttcattctcaccccaggtgagtgctggagaggacaaagctgctaatgacagaggacaccagggagcagaatatgtggcaaagaggtccttactgaggacctcagggtattcttggaaggctctgggccccatctgacttgcaggtttttgttttgtttctttgtttttcgtttttgagacag

SEQ ID NO: 138417 - DNA, 1841 bp, Homo sapiens
ggcactgtttagggcatggggaaatcagagcacatgttctctcaaggtcctgaggttgagataaaatggtttgaaactggggacagagaagggagcaagggcagttcctaaaaggtacaaagccgagattcaccccgctgcttccaggccagagttctgggtaggacgtcaatgagacccaggccggtacagccagctttcaatagagctggtctgtgaaacttggccgagaggacagaggaagattgatgtttgctccagagtggggctgtcagctgtgctcaccacctcaccatgctcccagctgtaaacaaaagtcctggcccttcatggcactgcagagcagtccaggctggcgtaagtctctgaggacagctagaccattttctcatcctggctgagaaccagaagacagaagaaacaatagaaggtggtgggtaggggtgggcaggattgcaagggggtgagaatcagtgaccagagggaaggagctgtcaatttcagatcttaggtttgtgcatccaagtacttagtacaaatcttatagggaaagcagacccctttccttgtcagcttcacagataatagtgaactaccaaaggaggcttgcagggactctagtgcctcattcattcattcattctttcagtgaatacctcatgtgcctgtcactgggctagatactctgggtgatgccaaagtaatacaagacagctcgtaaattcaaggaacttacaagaagtttgtaaacgtgtaaccttaagtcacaataccaatagtaagactttaaatcctaagtgacagacatagaataagagtttagaaacgagagtagtcatatctggtcatcatcagagaaaatggagtttgagagggctatagaaagatagacacaatttggccaagggaaaaaagataccaggcattccaggctaggaccaaattgttagtaacaatgaggcctgccttcgcgaaggcagaaagttagtatgacacagactctcttcagtcttcaccccgtcatgttcctcaccacagctaacccagtcttcaaaactcacttaaatgtcacttcctcagggaggccttccctgatctccagggccagattaagtactcttgctttatgttcccatagcacccattactttcccctttctaagacaccactattttcacctgatgacctactcatgtctccctacaatttgttctccactctgcagccggagtttttttgcaaatgcaaatctgttacatcacttccctcttggaaactctcctacctctaacatcttccttctcctttgccttcctggtccttcttgcctctttccatcttacttttccttctggtcacttcttaaatgtctctatctaagtttgtctcccctgccagaatgtcagccctctgagggcaggagttatgtttcttcctcaccatgtatctgtgtatttagcacagtgcctggcatattgtgttaggcactccacaaaaatttgtgaataaatccaagggagataaggcaatattagtagccaactgaaggattaatcttacacttctgtgcaaagggaaatctttaaaagtttttaaataggggtataaaaaaaatcatgagagaaccctgccttctgacaaaacaaacagaacaaagcaaaaaatgatcaaacaaaacccagagaactccaacctcagcttaccctaaacccggcctcccaatgatcttgtagactcatgttctcttcctttctgtttcccccaccactgcctcctccaaaaacacaagaaaacttactcattgatccttccaaccagagaaatttggcagtatggccaa

SEQ ID NO: 138418 - DNA, 1024 bp, Homo sapiens
acagagcgagactccttctcaaaaaaacaaaacaaaacaaaacaaacaaacaaaaaagcactttacctgcattatctcttgctttctctctttttttttttttttttttttttttgagtcagggtcttgctctgtcactcaggctagagtacagtggtgcaatcacagctcactgtaacctcaaactcctgggctcaagcaatcctcccacctcagcctcccaagtagctaggactacagatgtgcaccaccatgcccagctaatttttacattttttttgtagagacaggatctctctatgttccccaggctggtattgaactcctagcctcaagcaattctcctgcatcagtctctcaaagtgctgggattacaggcgtgagccactgtgcccagactgcattatctcatttaattcccacaacaaccctatgaggtaggtattgttattgctttcatttaacagatgcaaaagctgaagcacagaaaaatttgatgatttactcaaggccacatagttactgcatgctggatatttcagagccttcaaatgtccctttagaggaggaaactgagactgagggaggtgaagtcatttgtccaagaacccatatctagtaagtgctggaattgtaattcaaacccaggctctgtctggtaccaaagccaccagtaatcactacactgtcatgaatagaagctattaaaataaagaatatgtgtgcatttttctcgatccagctctgtaaggctaaatgttccttgaatttagatgatggtaagaattttccctattccataaaattgatagtgagagcatgtacttccttggtaatgccccatacggtatagtgcaaccaggatatttgtagaaagcctcatggtgaaagcagagactgagaaaaacagagctacacaggcagagtgacaatagctgagttctcatgtgacttcttcaggtggctccctgacataagatttacttcatcatccttccatgaagagaatgctttgtgagggaga

SEQ ID NO: 138419 - DNA, 1077 bp, Homo sapiens
accctgatcccctgagccctaccctggctagaggatgtaagcaaaggatgttggcaaaaaagctctgagggggaaagttggatccaactgctatttctgtttctatagatctaattattttcccttttctccaatcataataaatctaaagggagttatttggacacatttcccaggctggaaaaagccatttcacacaggagagaaaatatggccaacagagtaagctggtcttggctttttgtgactttaacatactgcacctgttgtagctggaggagcaaagatgaatggcttgaaatccaggggtggggcatcctgcatttgggtattctctatttaggccaaattctgaggggtgtttgtgtgtggggtgtgtgtgtgtgtgtgtgtgtgctggaaaggaacattggagccttaaataccactttgtggcttacatgcctattaaaatagaactttttttcccctggctatctataggggagaaggactgagaagctagagagggaagatatctcaaaaccacgctaaggagggaatgcacagtgtaggaggtaaagtgtggagatgggaaagagtgatttgtattgaagtgagaggggctagaaaaaaagggattagagaatggggaatgaagagggtgctggaggatgaagagaggtgggcagggttctgggaccaagcccttgagaggactgggcagtattttgaaatttcttccagttatcaagttattctattgatcatggcaaagcttttgctctgtccagtttgaaagacagtcctctccaatcagcctgtaaaagttggtgagctgggttacatgactgctgtgtccagagcctggtgctaaggcctgctgaggagatgaaaaagagcttccctttcctggggaagcttatggactagccgggaagacagtgtaggattgcatgggtaaaaagtaaaccactttaggcagtgacatgaaagggggccaccatgctatggagttgttggttgaggagagagttgagaagaaaagatgtgaatggctggctggttcctagaacactcctaactgactcttggcta

SEQ ID NO: 138420 - DNA, 1051 bp, Homo sapiens
cgacacagctaaagagggggtggggacagttagcttagaaaatggagtgtcctggccgggcgcgggggctcacgcctgtaatctcagcactttgcgaggccgaggcgggcggatcacgaggtcaggatatcgagaccatcctggctaacacggtgaaaccctgtctctactaaaaatacagaaaattagccgggcgtggtggcgggcgcctgtagtcccagctactcaggaggctgacgcaggagaatggcgtgaacccgggaggcggagcttgcagtgagcccagatcacgccactgcactacagcctgggcgacagagcgagactccgtctcaaaaaaaaaaaaaaaaagaaaaaagaaaatggagtgtccttttttcttgcccttctgctaggtgtatacacatatttttctaacccttggtatgggttaggaaatgcttttaggtttcttgaagaatgagtcctactcgaggacatgtagttgtggattagtccactagagggcgtactgcccagggaccaactaaaggactaaagggtagggactgataaattcaaaccactagatgagacaggagccctgccctcagcagaaaggaaccttagcaagggacatgaaaccaaggaggtagtttgtgagatatttttagtgcggacatacggtaggggtgcccctggagcagctgaggtgggaggtggtgtgttgaggagagaacattccttgtgctagtgtggcccagacaagctagagtcaggattttaagagtgggttcacagcattgtttcccatcccccagaggtcattatgctcttgcctctctggctttagagcctccagattagacagaaaacatggagtcagagctgaagacagaccagaactctgtgtctctaatggttaagcaaccagtatgtagctcagttaagcctttcagctttgctcataattggacacttgcttctgtgaggctggcccaggcacctctgttgtcatgacaacttacctagcacctattgtctgggcaattgggggtaaactgcctctgtt

SEQ ID NO: 138421 - DNA, 1100 bp, Homo sapiens
aggctgaggtgggagaattgcttgaacccgggaggcagaggttgcaatgagctgagatcgtgtcactgcactccagcctgggtgacagagcaagactctgtctaaaaaacaaaaccaaacaaacaaacaaaaaaacaaaaacaaaaactcaggaatctgtccactcgctatcctagcacatctgaagggttgcaagttttctgaatggtctccttgcatctactcttgccacctccaatctgttctccaaacagtagccagagttgttttcaaaatgtaaatctgattatatcactcccctttatgatccttcagtggttctccattacccttacgatacagtctttgctccccttatcatgatatctagcctttgcctacctgttcagtttcatcacaccccttgtaatctgctgtggtgaactatttcagtagtttcccaaagagccaatctcctctaacctttctctcatttacctggataacttttactcatccttcagctctcattttagataccacatcccctgggaagccttccctaatcatcccagtctgtgtcggttgtcctgctgtatgtgctcaggttacctacaacttcttagcatccatcacatacctggccattccctccactagactgtgagctcttcgatggcatggactgtttctatctcgatcactgttctgcttccaatgcctagctgagtttctggactatagtaaatatttttttgaatgaatgaacagatagatggtttagcaacatgtgatgtgtatatctgctggcttctgcttgctctctaccctccttaccactacctgccccaatagctgtaggccatttagatgataggatctagatagaagtggctccttccctgctgcaactttaggtctaatctcctagcctctggaataaatttccatttagtccttccattctgctttgagctccctgcagttgaggggatcaaagtcctggcaaagagatggtaatcagtgcctttggtggcaccataaaggcaaagtaacagttgtttcttgggaacatgaggaatggccactccaatctagttcccttacaaagtaagccccta

SEQ ID NO: 138422 - DNA, 1038 bp, Homo sapiens
tcatcaggatattctcggtaggacaggcgtgggtcattccactgttgccgcaagaagacattcacccggtagtcctgggagggtgcagatatgggcccttcagaaacattgccattcccaggggcccagcaagcctgtaggggcaggagggccatgaggaggaatgttgggaacacatctcaggggcagtaggcatttttcactggagaaggaaccttccttgggctgatatggcaaaagatgccagcttgttatctggtgggctcctcccactcacactaggctggaagtggggagcagggagatcccttaccattgtggtcttggtgatggagctgaaactgttgatgaagatgttgcaggtcacgttcacgggtgggcctgagggtagcaaagcacaggccattggcagggcattccaggaggctgggagcagcttccagaactccttccctgagctgcaggccagggcactgctgggagaaatcagtgccagatacacaggcccatggacaatggggtgaggaggctccttctgagctgttagaaccagccccagccctggacctccagcctcctttccttagggaaggcaataggggctggctggctagtgtgctgccaaaggtggtggggagggaggagtttttataggatgaagatttcttacctttaaaattgggccgaatcctggcatcatatccagatgttcgccccataagtttgtctaggaaatcagagggggacatgggctgggaccccttggttccagatttgacttcctcttttgccaaggccaccctggacaggagaggtaaaaaagtctgaggccagttatgtgctgcacttatcacagactctcagtttccatacccctcaggcaggaggatagaagacaatgggtctctgggtgccatttgcaaaatgagaacaaaaacgccataagtcaacacggcagcctgccagttagtactagtaaagtgttttcacagacagtaggtcttcttaccctcccaattctcagtgagatgggagtga

SEQ ID NO: 138423 - DNA, 1040 bp, Homo sapiens
aggtcagtggcagccccaccttgaccgtctagagtcctgcctccttgaatcttctaaggaagaggaagcccttaccctggggacagaggcaggctctgaaaatccaaggaggctggtggtggtgctggagcaagcagaagtctgtgacttcaccacaggatgtccacgctagccaggtgctgctgctgcttctggccacctgccacctgcctgctgggaggccacatggtcctgcacgtggagaaactggaccctccccgccgtcctcagccccactctcaggtcacctctcctgctaagcctagacctagtatcctgggacaggctatgggcttagcagtcttggtccccagcccctgttgcagtaccctcttctggggctaacttgtctgaggacctgagagcagagtcaccgtgtgcagccactccttcctctctttcattcctggaaagtcctaaacaccttcaggacctaggaggatccagagctgacagtctttctcatgtaaagtcttggggtggcgcagggagagaagtctaactctggtgctaggtagctgagccaccctgggcaggtcattccccatctctaggcctcagtttccgtatgtacaacgaaggacttggactccagactctctaagggcccgttttgctctaactgcctctgctttccaagccccagtgggaatgctgctactggagcttgagctttgaggcagcctcccctcctggagggcctgcaaggcccagtgtggtgcccccttctgcctgcatcctcctgtcaactccagctgtgctgccattctactttgagctgcttttcactctttagaagtttattgccctgctctgcatccctgcctgcctgccagccaatgtgtctgcaaacagtggggcaggaggctttgcagacgcaagcagccctgcgatgtttcttggattaacaggaggaggaggaggagtatgccgcagtggtactgaccccctccaccttgggaggcactcctcttacgatcaggtcagcccaggctacagcc

SEQ ID NO: 138424 - DNA, 1082 bp, Homo sapiens
tgtgcagccattcccgtgcctgctttcctccctcaggtcgtctcttggggtcctctatagctctcagaattcctcctcccagacactccttccccagcctggctcatgggaagggacagagatgcagagcaaggctgggacacagtaggctttgcaggcttcagaggaatggcagcgggtcaagagcagtgacctagtggccctcagccctggatggaggacagaggcagaggggtgggctggcctcttcccttgcctcctgcacatttgcttacagcaacaaggtgctttggcagctccattttctcctgcctgactcttcctcaaaggttccagtgtgttatctaaacacctctgagacttctcccctcccccatttcctcttgctctctcttctttttttcactctactcctctcttcctcccccctccctgaaattttccttcacggaccctctgtccatctccatctccaatcttcctcgcagtttcttctctgcgtctcactttctgtgcctgtctgccttgcttctttcttcctcacttcctctccattcccggttttctctttccacctcccctgtatcttcactctctcacactctcctccaaaacgacaacagtgagaagccaagcgttttcatttctccctcagggggaactctcccgccagctctgcggagttctgattgcatgctgtggggaggggtctgtgccaccttctgaggttcaatcctggagctgactgtggcctcctcaaccttgccagagagggtttgaggggattggaagctcctccacatggcctattggctatatggaaggattaataatgaggtagccgtgagtggaacctgtgctgcagctcccttttggctgtgttattattaaggaagagaaattttcaaaccataaatgaaagggtaagaagagaattttaaatgcacactaaaatatagacaggggtgctgggcttttggagttgggactgagaacattacaagtctcaaataatgcctatatggtcagtaaatgtaaaataacctaaaacatctttagctgccctttcatctgctcaccct

SEQ ID NO: 138425 - DNA, 1987 bp, Homo sapiens
cagtgactggttcaagtctgatgcttcaaagatttggcttcattcttttgtttaatagaatatttcaggtatgagttttgcagacaaaaacgtgaagtatgtgaacttggggaggccagtggagaggttaaccgaattcctctcagtctccaaagacaaaccagatgtgagcaccaggatggcaccagtgaacaatggccctgcctctgttgctgggctctctgttaagaatccagggaacaacagagtggtgaagctccagctagggaaggtgtagtgactagcatccagatatgcatcatttctctccttctgaatggaccttcagaatcgttactcatcacatcagccacttgagagcaattcactagctgtgcagaagagtttcattaaggtttccacagagtttgcattgactttccttgtctcttggctcttgtaactctgcaacattcttgttaggggatgataggaccatgtcatgcctctcctcaaaggtaaattggtttttgcttgtgatcatgttcatgaatatcttattttactcatttggggattgtgataatgcatgctatgtaaggcatgaagcccttacataacataaaagcaacagaacttggaaaaatgaatatttactgtgtggaatggatcacactcccgctaattcatgcatgcattcaacaaatatttattgagtgcaaatcatatgccagatgccagatattctaggctctggagatacaacagtgaaaaaagcagatggagtccatgccctcatgtagcttagattctagtgggtcactaatgtaattccttcccaaagaaggcttctgcctgagtcatcagcaatgccccagggcctgagtgcctctcacagcatatgagtagggcatttattatatggcctagaaaatagactatttttttcagcaggcagtaatgagcttcatttttatctatcccagaatctttctgctagtcacatcacacaggtcatcacctgctagacaccctttcaagaagcttatccttcaataatccaaccctacagaacacgcatgcccaagaaccctgaaaagataatctcatgattatctcatgatgcatacatatttgtctgcaactgttaataagcaccttcctcactagaagagttaggcgagattaacagcatccttagctgtggtgcttctctgagtggtttccaattatttaggatccttccttccttccttcttcccccttcaatcttttcactttatctttccttcagtctatctttctgtctgttctcctgtcttttcttctgtttttcttttttggttttactatgaataaatttaatgtttgttgtaataggacactggacactaaagtaaagaacagtttggttgattactacatagaattgtgcacaaatctgaatttgcattactaacaccaatcacatagttatagttggcaaatgttatatgccaaaattataaatttaacattacaaatgatgtactagcctaaatttgcacttctgtagtgttcattatctgagtatacacgtgtgcatgcagacacacacacacacacagaactctccttgataatctgaagatgatatccctgttgctaacaattattatccaagagtgtgtggccaaagaaattggagtgtgatgactagtccattttatcctgagtacaggtagatcttgtctttgttttgtggctgaggtctctacatttactgtgctaatgaagtgcttctagccagtcacttgcccagaataattggaatccctaggtaagatgccaaattgagccacttctctttgtacaaggtaggggaggtattcattttgcagagttatgtcgcatatggccccaaatcacagattctaatcaatgacaggcactcctaaagagtcatctcagatactaatcagacaataggcaactccaaaccacatagcaggtcacacacatgagcttt

SEQ ID NO: 138426 - DNA, 1316 bp, Homo sapiens
agactacaggcacttgccaccacacccggctaattaaattttttgttttgttttcttttagggctggggtgtcactatgttgcccaggctgctctagaactcctgggctcaagtgatcctcctgcctctgccttccaaagtgttgggattacaggcatgaaccaccatggctagtttaaatggtttttcagggtcacatatctcggaagatatgtgggatgtaaacccagcagcctggccccagagcccatggtcttcatggcagcagcatgtgtgccgcctctcatgtgtacaagtgaatgaagaatgaaaggtaagcagcgcaccgtggtcatccccgcagccaggagcctccagaggtgccattcagtctctcaagtccctgggttttggggactccctgtcacaacccctttggggtagcctcccacccctgccactgcatctcttcctccccttgtcttctctctgtctaattgtgagtgctgcgctaagtaggtcactcccactgagggctttttttttttttttttttgagacagagtcttgctctgttgctcaggctggagtgcagtggcctgaactcactgcaacctccgcctcccggagtcaagtgattatcctgcctcagcctttcgagtagctgggactacaggcgcctgccatcacctcctgctaatttttgtatttttagtagagacggggtttcaccatattggccaggctggtctcaaactcctgaccttgtgatccgcctgccttgggctcccaaagtgctgggattacaggcatgagccaccgcgcccggcctcacccagggcttttaatgagaagttttgccataccaaggcagcaaagatgaataattcagtgaagaaggaatgttattcttttttttttttttttttttttgagacagagttttactcttgctgcccaggctggagtgtaatggcgcaatcttggctcgccgcagtctctgctcccaggttcaagtgattctcttgcctcagcctcccgagtagctgggattacaggcatgagcctccatgcccggctaattttgtatctttagtagaggctgggtttctccaagttggtcaggctgttctcgaactcctgacctcaggtggtccgcctgcctcggcctcccaaactggtgggattacaggcatgagccaccacgccctgccttttttttttttttttttttttgagatggagtctcgctctgtcacccaggctggagtgcagtggcacgatctcagctcactgcaacctccacctcacggattcaagtgattctcctgcctcag

SEQ ID NO: 138427 - DNA, 1033 bp, Homo sapiens
aagttgccctgaacctttcctgaggaatgtgtcttctgtttctttagagagttgcactctcaccaatgaccagctgccttctgggtgaagtgaaagtaagtaccctgctgactttgactttctgtctcctcttcttgcctttggttcaagacggagcaaatcactttgtgctgcaaagagctgactgacacccccacacactgcatcatcttgcctttggggaatggggaagagagtgggcagggttggccttcatcaagaccgttgagggttaacacaagttggcattggaggcccttaccaccttcccaagagagatcctgagacatgctgcctaatggaaacttgccattcctcacttcagcattccctttcctctctctaccgctttcctccttcaacttccacagctccccaggaccagtttaatttgtccagtattgaaatcatcccaggcaaagcagccagcctcctctctttactaacaactggagtgaggactgaggaggcctggaggcttactggttgccatggtaagaagtaggccctgagaggattaatgagcagagagctggagtttttttgtttgttagttttgatgagttttgtttgcttttcttcctccacccacctgcccccctgttcccctcccacctacccctccagagtctcaaaccactaaagcagaaggagattactaggagcaaaatcagctcctgacgtgggctacactaaatccaggctgccctgctgagggtaattggtgtacactttgtaatgtagactctgggagagccaagtttggaaggcaagatgtaccacctttgtggcatggcacagcatcctgaggcagagggggcctgctaggggaggagggggcgttgaagctctctgaagcctccacactttttcctttctggccaaataggaaagtcacaggcaaactaaaagccagtttaggctgagaaaggcagctaagtcctgaccttctgtcttgtgtctgccacaccccaagatccctttctaccagagt

SEQ ID NO: 138428 - DNA, 1404 bp, Homo sapiens
tccacaaaatctccttcaatcagcttcctctcttcccactggtgagcaaggtagatcatattcatagagaagatatgagctcctgaaagggtgtgaggttattatgttacaattattcctgttgttattagtgtttttgtgttattattattattttaaattagttcccttcaatttaatccatggctctgagaatggagacagctgattcagggagattttttggactgggtacctgaactgcactaaaaaatgaccttgcttccttattaattagtaatctggggctgaggagcaataagaaaggagaagggcatgggaaggaaactctgagcggaccagcaaggccagataatggccaatggtgaagtctcagtgtctcctatctcctctttcattctgtggcaactgcataaagctaccttgattcgaggatcatctcacagtgaaaatatccaatggtgtccctgtacttctagttcaatccttttatccatcccagcctaggaatgggtaccctgctccctttttgaccctccaaacatgtattctcagtttccaaggtttctatttatcctcacttaggtattgctttatgtatactctcaaaaccttttcttctctccatgggtttattttcccagcaagatggcatatttcctgaaggcaggttctgtgtcataaactccactagaatcccgcttcttcagggctctgaatacgatgggaacttggtgaatgtatcttgatttactgctcatgaagcaagagccacaggaaaggtccatgctatgaataacaggcataaaataggagaaattggcttataacatagaaaaacaagattaaatgcttatgtcatgccacgtacgtaataaacattagaggtactgcacacttaaacatgaaaggcaaaactatacaactatagaaatattggagaggccgggcgcggtggctcacgcctgtaatcccagcactttgggacgccgaggcacgcggatcagtacgtcaagagtcctacacgagcctggccaacgtggagaaaccccgtctctactaaatttttggtagagacagggtttctccatgttggtcaggctggtttcgaactcctgacctcgtgatccgccgctcggctcccaaagtgctgggattacaggcgtgagccaccatgcctggccaacatttctatatccccctagaactactctcacaggtacacaaagtagcttgcatgaaatgtttgttgcaatattgtaatacagagaaattgaaaacaacctaaatgtccatcaacagaggaatggataaataaaatgcaaaatatgcaaatcatggaatattatatagtggttaaaatgaacatattactttcacagttatcaacagaattagctctca

SEQ ID NO: 138429 - DNA, 1027 bp, Homo sapiens
ggctctagtaacatttgtcactgccttaaaaatgtttcaatttgatgtcaattaatacttttttttttttttttttgagacaaggtctgtctctgttgcccaggctggagtgcagtggcatgatctcagctcactgcaacctacacctcctgggcgcaagccatcctcccccttagcctcccgagtagctgggactacaggtacgcaccatcatacctggcaaatttttgtattttttgtagagacagggttttgccatgttgcccaggctggtcttgaacttgtgagctcaagcaatccacccaccttggcctcccaaagtgctgggattacaggcatgaaccactgggcctggcaatactttctttcctattcattagctcctatttggagaagaagttgagggaggttctctttaaaaatagagactgtatcatcagggctgctggggaaagggaaagagacattgtatctttgttggaatttgggctttctaagaggaggagtagaaactatgctggtggttatggtggttgtgggatgaacaacaggatggatgtccagatggaccaagtcagccctctattgtaattcctggatgaaagcttgaaggacctaatctcaagaacaccaatgatcctactgtcctcctatatatatgaacagagatgggaggatgttctctggttatttaataaaggccagccacaaacaaggcaccatactaggtttcatgcgcgtccatgtgaaatcaccaaacaggctttgtgtgagcaataaagctttttaatcacctgggtgcaggcaggctgaatccgaaaagagtcagataagggagataggggtggggctgttttataggattttggtaggtagtggaaaattacagtcaaagggggttgttctctggctggctggggtgggggtcacaaggtgctcagtgggggagcttttgagtcaggatgagccaggagaaggaatttcacaaggtaatgtcaccagttaaggcaggaactggccattttca

SEQ ID NO: 138430 - DNA, 1030 bp, Homo sapiens
tctactcagagtaatgtgtgcagagcacaagggtctttgtccctattggactccacagagtcctgtagacattgctaacatttggcaaaacaaagatagcagcttaaacacatcctaaatgaaatgagactcagttgccccatgtattccctatcaaatgtagcatccagtagacaacatccacagagatcaatttgcaattatactgagctggttcagcctttaggttgtttcatcatgaaacacagagagaacactttgaagcatgtgttcaggtaaaacaggagggagagcactggacagggagtcggaaaaatcagattcaaatcccagatctgctacttatgaactatgtgaccttggacaggtcactgaatcaccacttcctcatctggaaaatggggacagcaataactactttgtctactttcagggttgtgagaatcaagtaacaataatgtcaaagtcctttgaaaatgggcaagatctataacaactgtaaatcatgataatacctactattagacaataatgtgtatacaggcgaactcttcctctttccagggtggttgggttttctttgcgtgcttgggtcagaatcatttgaccaattatgtgtgaccagatgagaggtgaatgttggaggaactcaattcctgccctgggtaacatcaggaatcctatctaatgtcagccgagctgactggataggttgtgcattaaaaacagagagggagtaaagaaggatgttgaatattacttcctcaggggatgaaatccctgaggaaaggcaggaacaaataaagtgaccacagggacaattgcctgttatggaggctgggtggtttcctccagaggaagagtgccacagataagggcacgattgaggatgcacattgggtcccaggtcctaagggtggacgatacttgggccaggtacatatgatggagcagccactgagttttcatttattcaataacagagtatctaaagtactttgaattatagatcatctctaacaaggtactg

SEQ ID NO: 138431 - DNA, 1642 bp, Homo sapiens
ctaaagaagaccaagtgaggacagtgacatgatcaggaagggtcacagcagccatggtaggtgaatggagcagcttttccttcctttcctgctttcagagcctactcagtgccaaacttacatcaaaagctcagcaagtactgattgattaatccctcttgcctacggcaaaatggccctgagggctatctctcagctctgcactggcctctgagctgtctgccaggcagggctctagaaaagagtcccaaggaagagaataaggttccccaaatcagcttcacactgcaacaaggagagaggaggaaatggtgggagactgacctgaggaacaaggtatggctactattgtctctagtaccagttacttccctttcatcttcccattcgtgggcaaggtggagacaatgtgccaaggataagttttaacaatcaaagtcctacctcagcttcccaatgcttgcacataaattggaatgtgtacatcattcattctgtctctctctgtgtgtgtgtgtgtgtgtgtgtgtgtgtgcgcgtctgaagaggagtggggagtataggaaacaagatagtccagatgctgttgccgtggtaatactaaatcgtgtccaaagaggaggctgagattcctttttagttaaccttgtccacatgatttgactatccagcaggcttggattcccaggccccagagacttcgggactgttttccagcacttgaatgtggtatataagtgctgatatcaaaagggatatgtaggaaagacaagattataggcagggcattgtctgaccaggacgaggcccgaagcaaaagtctttgtttgtctctggcacctcttgataattgttgttttactcctagaacccacccactgatccccatccatccctagtaccagtcacggctgctctagcatttcggccttgtcaactactgcaggccctgatcaaggaggcctctgttcatggggtaaggttaaggggtgggttctgggaggagggtaagactgtagtgcagattcgagacctagggaggtggggccagtttctcactcaatgagcctgcctgttgtttagctctattgtatagggttcttctatctctccctttgtcagctggattcaagggacaggctgggaattgtgcagggtacaattggtctctttctaccattcctttcgatgaaagcccttcctctccttcctttgatgagttcccagattcacactgaatttccatcatggagctggtccttgaggcgggcccagggcatgggaaaggagggagggagggttgggagctcttggtgcctgcttaaagagacagcatcaggatcaacacagtcccttgatgaacctggatctgtgtaagtcacattggttctgttgatctctgtcagaccgctgtgaagagcgctggtgagaagggcttaaagttggagtatcaactatcacagattgattagacttgttttgggagtttgtatacaaatgtagccaaccatgacatgatcttttccctttgcttacattttgcccacacaacttcgttatatccattttaacacttgcttataggtagctttagattttgattcacagacatatgtttgttcaccccaacaggatttcaagt

SEQ ID NO: 138432 - DNA, 1062 bp, Homo sapiens
catgcatgtgcgtgtgcacacacacagacacacccatgggccagctctgaaaagacactcttcccaagcacgtttgcaaagttcatgctgagtaaactcagcctccactcacagcagcacagctacagattgcttcttatagaggccaagtttcctggcagcaatgctttagttcttggaaaaggaagttctgctccaaatgttagctgcttactttgtttggcttgggcttctgaggctcatctttggtgtgacactctttgaaggccaagaaagggctgtcatttcaggggatggtgggtaataggactcactccttttgtgtctctgagaacagaggcaaatgcctctacctcgattttcccatgacagagataatttgatctttccaaatctgttcacactgatgcaattcagccatgtaaatcactaggtattcatgctctctgggctaaaaacaaactgtaactaatgttaacagaatcaggaaaaggagtcccctttccctggtaccctatagaaaagtgagtgtggcttggagaaatgcttgaatacaaaaatccaagcctaagtaattaatacaatttatttttattgtacaagctgtcacaacctgcttattcaaaaatagcagcttcccagtacatttgctgagtatttgtgtgtgtgcatgtgtatactgtgtttatagatatataaaatcagtgggtatatatacatatatttatatatatacatacatatgaattaagacattttttctgaagagcttaacattctcatttcttctacattttagggatctggccgagaggccagaggaagccattcttttcctcatctagtcagtcatctacttggcatttgctaaggttcactccatatgacatcttagagcatgggactagtacttggaacacagctgctttcagagcctgtgacttcttgtgtgcctctcctgtttctcagcaacactggcatagggcctgggataccaggtctggggatctcagggactcttagcactttaagacacatgtgttcccaggccctggtgtgttc

SEQ ID NO: 138433 - DNA, 1018 bp, Homo sapiens
agagtcaagtaatttctcaccttgtaaaacgaattgattcattaaccaggggagagctctactgcatgatgtggctgtgtgtctacagcaagcaccctatgactctaagtcactcggacatattgatgtggcaaagccaaatattgttcacttccctgaggaaaactcagtgctagatcaaacagaggtgtggaataaatctttatgatttgattctctgggcctgggccatgagacccatgatgcctcagagacatcggacttccagtcaagtgtatatggagaaagccaagcctgggatgtactgctttttgcagagcatgggtttttcccttatttagttatgattttatttctacccttcctcattcccaaagggatttgaggagggagtgctttcttttctactctcattcacattctctcttctgttccctacagctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaa

SEQ ID NO: 138434 - DNA, 1016 bp, Homo sapiens
cagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatgggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttc

SEQ ID NO: 138435 - DNA, 1008 bp, Homo sapiens
ggatagtactggatggaaggtttagtacttaaaggacagagcaggtatggaaagggcaacgtaaatgtaaacaggctgtggcagggcagtactaaaataaattagtgacacctaccaccctggatggccagcctactagcccaccggggacatagcattaaagccctttcacaaccctaggttagaatttggcacccttggacagcactctgatgaccagcttaaagaaagctgtcttaaaatcatttcattgccccatagttgcagctggcaaatgactggagagaaaggaatctttagctggagggatgacaagtcagtcatcagttaaggagctccattcaaaagcagtttcaatttaatttcctgatttctgcttaaccacaattaatattctgcaagcgagtctggttgaacgactttaagacataaagaataaaaatatgacagggacttattttaagacactgcaaacaaggacacagcaccatattttggagaattgattcagggttctacagagtgattgtatttttgcctcagaggaaccgaaagccagttcccaagaaagctatgttttccatctgcccttatttggctctgcctctgggatgaatctatagatggagtttctaggctctcagaagctgagagcatctccagtctatcaattgaacccattgttcttagctctcccacacaccataaacctccttttttctaactgaaagagctctctttgtgctgagatcagccgaagatcaagatgcagcagtataaacaagaaacattttcttacagcaccagttgtattgcttttcctatcttcagggtcagtactgagtgcagttatgcaggacgtggaagctgcagctttgtccagagcaacatttgttcattccttaattcgttctgtgaacattcattgagaaactactaagtattgtgttaaaccccaggaagttcaagtttgggggcagtgtgggtagaaaggtgatcaagaccaga

SEQ ID NO: 138436 - DNA, 1014 bp, Homo sapiens
ctagaactcattatcaaaattattggtgtatagtctgttctagcatagattagctttctcaacctgctatataaaattaccagcaagaaaaaaaggtgcaagaataagatttatggctgaagtggcttggtgtcttgattctctattctagcattctcagaaggatcccatccgttagacacgcagaaactgcagggacatttgaatggtcttgattccttcttaactcccttaggctcctcgtttgttggtcttctttcatgcatacgaactctgccgagtaacatgtatctcgatcttgccatcttttctctctgcacagacagcaatgttcttactcctctcctgctgtaaagccactcatcttcgatttccctgaggacttctgctcctacagactctcgacggagtaaagcttccgatagaggggaaacagattcgctactagtgttgatagtcaagttactaaggttctttatcaacgtctcggagcagatttgagaggcccctgaatcgtcccgggaattttcttcggtgagcatttgtggagactctgggatgtaggttggattaaacttctgtgatgggtccatcggcgtcttgacacaacactaagcttctcctggatctttgaaacgtagcagaaactgatgacggagcctcaaattgctacaaggtagcccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcggaggaggggaaggaggcgagtccggaaaccctcggccaatcagagagggctggggcggcgcctgctagaaggcttagcactgcagggctctgggcgggaaggctaacctggtgcggagccagcctgggtctcagccccgcgtacggcctttcacgagtctt

SEQ ID NO: 138437 - DNA, 1050 bp, Homo sapiens
ataacttttctaatatctgttgctgtttttctgttgaaaatgagcaggtagaatatacattgataggaaatgtgaaaatttttgcttgtgatcccttagtccgaagatagttctgccaggtaagttttcttaaaaatgtttttttctgtcctggcgcggtggctcacgcctgcaatcccagcactttgggaggccgaggcgggcagatcacttgaggccaggagttccagaccagcctggccaacatggtaagacccccgtctctactgaaaatacaaaaattagccgggcatagtggcgtgtgcctgtaatcccagtttcttgagatgctgaggcagaggaattgcttgaacccaggaggcggaggttgcagtgagccgggatcgcgccactgcactccagcctgggcgacagagcaagacgctgtttcaaaaaaagaaaaaagttttttcttttcaggctttcttctagtcaagatgagtgataaaccagacttgtcggaagtggagaagtttgacaggtcaaaactgaagaaaactaatactgaagaaaaaaatactcttccctcaaaggaaagtaagtcatgtggggttctactggaaacaaacaatagaggaagttaataggttcagtaaataaacctatcttctagtaattttttttacacaaagtaagcaataattagagtaccatggtatttaatgcaacagttaaaactatcaaatagttttcttctggttctcacatgatgggcccagtagtgatgggggaataaaaaactagttttttgttggaaaattattaaaaaccacattaaaaccaatcttggaatattggatgtagcactaaaaaacacttagtttttgtctacttttgggtatttggcatttttctacatttaaaaatttgagtccataatattatccctaacgaaccctgtagactctgcagttttgaccttctatatctgatgaaaagataaagtgagaacaaatttagatcttagtatgcttaaagctctcagattcaagggattgattggttctgccc

SEQ ID NO: 138438 - DNA, 1024 bp, Homo sapiens
gaacaatttaattgttatcttgcctttattcctattatctcatttttaaaaaatgaaactgctaatataacttatgaagcaacttatataccaggtgctgtgctaagcactttccatactttgtctcatgcatccttcatgacaatcattttacatataaggatactgaggatcagcgagatgatgaaacttggccaaggttataaagctaggaagtgacagagtgaaattcaaacccagggctgcctgtatccagagcccatctctgtgccctacaacacaatgcagcggagaagacaaatgtggtcctcatcttaaatgggcttctctctgtcaaccacagctctatttccttctcaccacatggggtaggccagccccatgcacaactcacactcttaagcctatgtgccttaggccacttcctcagcctagaatgcttgccctcactcccctacctaacaacagcctattctactctactcaattaaggattgagtcatatgccccttctcaggtggaataaattgctgttgtctttttgcttccaccttcattactgtaccctttattttgtctttctgtagagtttagcacactgttgacctgtctcccaagctagttgactagatttctaagcacttgagggcaggcaccaagttctattcactctagctctatggtggtttacccacaatgatttagtggatgatcaatacatgtttgtgagcagaccaaaggactggctgagagatgccctgaatgaacagacaaatgcattcatttgtggctggatcctggggcagtcacacagtctacccatgtggactagactggctgggagagtctggaatcctctgggctcattttactaggctgtaaacataggaggcaggtcatagggtacaggtgatatctgcttaaggccaactctaggtccattctgtggtctatactttgaattcatgtgaaggggccaggctctcctagattgcttatgttgcaccttcctatttgtggaagt

SEQ ID NO: 138439 - DNA, 1490 bp, Homo sapiens
cccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcaga

SEQ ID NO: 138440 - DNA, 1063 bp, Homo sapiens
tactgggccctcaaaacggaactcaatggttgtgtgtcacagatttatgataataagaaaccattaacctcatggcctcaggtctcaatcacacccccttgtcaacgtttcccccgttatttctcagattcttacatgagctcggaaactagcgttcgcctttattttacgtgcagcctctgcaacaggtgcctgccgtgagaaaattagcctctggggtacggccgacttttgtccactgggtgtcgcagatcccagtcctcagggcctcaagactgtgccgcgaaggagggaaaggaagggttggaaacagcttcatctgaaaacctgatacctcccctccaccgcctccactgtcgccaggcggaaaattccctctcccatcttctgaacgcaagccaaagtgcctcctgccctcccgcgcatcccccttacatttcctccgggagaccctcgccctaccagctctgcaatccgccgcacagaattcaagttcggattcggctttgatgacctgccagggagaaagagactagaagttggataacctcccaccctcatattccttcccaggaagagatgaggagatgcaaaaggggttcaagacagcttgcgatcgtctcctcccgccccttgccacctccccgaacacaccccgcccccgacacccaacaacacccccgacctacgacaacacccccacccaccttaatccaggcaaatcctaaatcctatccagtcggcagcatccagatgaaccacaactccttcctcagcgcaaccaggccaagggagtgctccatcccctgcctcgcagttactgattctccaagccgggcgccgcccagtcctggcggggcttcccccacccctctccgcgccgggcaatcgcgcgttctttctttacttgtgctccactggtgggcagcatgtgctcccgcgtccacagctctgtttcgccttccggtccccgtagctctgcaggggaacgggatctctgccgcctcctcggccgctaagcgacccggggctgcccgacctagcgagtgcgcacgaccgccca

SEQ ID NO: 138441 - DNA, 1685 bp, Homo sapiens
gtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaactatttacttaacggtcatcagtaaaaaaccctaaacaaggtcatgatataatttaagaccaattcccctactctcccaataatcacatagtcttattactttcaa

SEQ ID NO: 138442 - DNA, 2582 bp, Homo sapiens
atcttatagtagtatctcagttcctactacagctttctaaaggatgagacttgcatttaacaaaatgacatatataatatttttctatagttttgcaactgaattaaaggaaggtgatgtattataatgtgtagtgaggtataaagggctagttcattctctcccaacaagaacttagaataaaataacacttttttttcatgagacttacctcatttttgttaggctatggcagttttgtccagttcctctgtcccttgagtgaattagatattggtgaattaatctcagaaactgacctataaaataatgactcattatagattgggtgaacttctcattttatttagcttttaaaagtgctaaatcctctcataaaggaaaaattataggaaactatagcggtatccagattctgatgagctttaaaaattataaaatatagcaaatgtcttcatattttagccagaaatattagtacacaaccaatatagaagtcttgtttgtttctgggttctccagcagagactttttgtttgtggcttactctgtatagcctcatgtgccttaaaggtggtgaactctagtttttgtcaatatcaggcttttcaaaactcaaaaacaatccaaatgttgtaatttgttttgcataatgcccatggaattggatatcagtaagcaaagccattaaatcgaaccaatcaatgctaatagagtataaaaacaaaaaccttcaaattttaagtttcatttgtgtaactttattttcggcctagctagatcattgaagagccttgaaagttatctaaagtatggcttaatgtatttttttccctctgaaaaagatcatatgccaggatacttcttcaaaccagatcacttttaatatctagaaagataattttcaaggtataggcaaaagcacttcaaggacagagattatgtagcaagttgattctctaggaattctttgaactcatttgtgtaatagctggaacacactcctcttctttcctttaacaaatgaacttttagcacttctgtcttcaaggaaaaacatttgtttggaattgaagggtactcgcagtccgtttatagtttgggacaattaataggaaaatccccagttgcattcaaataatagtgttgatgttgagggcactgactcattcagcatgtctgaactagaagtaaatttaattctgaaaggactgttagttaggaaataagtatttgtatacatatgtactgtggtaactttggattcattttaagtctgataaagtaagataaactttgtcttaaaaataaaattatgctaagtgaataaaaactgagatattttaagctaggcatctttgttagcatagtatccggaacataactacttataatgcttaggtcttatttctttggaaaataagttacttattccagaagccttagaaggaattctgaaaattcttctaactggccattaagagtaaggaagttgaatggtactgctgaagatctgagttgactcactgaaattttattttcttatttttttaacattaaaattatttctttttggctctccctctagttattttttaaattaaggtaattactgttttaacctagagcatataatggcaaattaaattttaatttgacactcataccgaactcagaaaagcttgtttgatcttctctaaattctgtatgtagtactttttttaattgtcacatttctttgttacatctttgtgtccaacaaaacctgtggaaatctgtgttcatttttgtggtgagggatgggggtgaaaaaggggagacttgctctaattatgcatatacatttgactatgtaaaggtagttgtagactatatgtataaataacaagttaacacttaatattctaaattgttctaaggaacagtggcctgaagccatgactagttttgtggagctgctggctcttttaacagtagctgacctattggatttaaactgagactgaaattgacatttgtggttaggttatctagctgaggcttttaacaatggagcagataatgtctgttcctgtagtggatccatttaatttcctatttgagtactctcacttaacaagtattatctattctgaacctttgtgttgggaatttaaggactattgtcaaaggctattaatggtaaacaagtatatgcaaaacaattcacatatgggtaaaaatttcaaattgtgggtttttgtttttgctttttagtttcaaagattagttatgtagcagcaatatcataaccaaagcaagtaggaagttgactggtttggagaatcttcaagtagttttaaatactgtaatgtatcagattgttaaccaggatttttttttcctgtattactgctaaatatattactatattaatgcacttttgtatatataactgtcttctgtacattctgtacttactacagtgtatataaagcctgttttccctgaagctgtgagggaataacaatagttgtatcataagtcgtttctattttgagttccttcttgtacttgaaagtagttcagtagtgaaatctaaa

SEQ ID NO: 138443 - DNA, 1048 bp, Homo sapiens
gctaacaaaccatcgggcgcttttacatatgtttcctttttctatcttatttaacagcgaagttgttaatgggaaaaacctccctaaagcgagtcccaaccgtattacagaaaactgcactgggaggtgggggagagaaataatgtacattcatatatatatatatatatgttttttttttgagactcactctgtcgcccaggctggagagcggtggcgcgatctcttctcgctgcagcctccacctcccgggttcaaacgattttcctgcctcagcctcccgagtagctgggattacaggcatgtgccaccatgcccggctaatttttgtatttttagtagagacagggtttcaccatgctggccaggcttgtctccaactcctgacctcagcaacctcttcggcctcccaaagtgctgagccgagccacgttcatattattgcattttatccacaactccaaatactgaatatttgtaattttctcccctaagagagagacttgcagcacgcctgaatttgactgaagacagagtgcaggtcagtaaatcttgaaaaagcaatttggcaggacagccattctaaagcatgctttaggttttgtcctggacattctcaagctggtgttttctgttgtcttttccatggttgacaaataagttttgaacagtaggggctttagtggtagaaaataggatgtgtaaacttcagattatggaaattgctcataaacagaggaaatatgatttcctaaaggaaaaaaagatgtgttttcatcttccttctatatctgtatctgtctttctctccatatagtgtatgcacatgtatatgtacatatacacatttacgtacacatatatgcacatgtatacacatacatacatacatatatcccaataaataagattaaccttcttctaacactggtatcctctagggagaatgttagttttccctaaaggattacttctatatggagtcatgttcggggctcagtctcacctcggaagtattcaaattaatgcacagaatagctcagtttta

SEQ ID NO: 138444 - DNA, 1025 bp, Homo sapiens
tcctattttaaagatttgctggtcaggtgtggtacaagctcatgcctgtaatcccagcagtatacgaggctgaggtgggtggatcacttgagttcaggagttcaagactacgctgggcaacatagggagatctcatcctacaaacaataataataaaaattagccgggcatggtagcatgcacctgtagtcccactacagccaaaaggaggctgaggtgggaggattgcttgagccccagaggttgaggctgtaagtgagctgtgatttcatcactgcactctggcctgggtgacagagcaggaccctgtctcaaaaaatagggcaaaaaagggcacattgtgccatgagagtgcatgagttggggacccatcctgatttagaccttaaggaaggttttctgggggatgtggaatttgagttgaaatgtgaaagagagaagatcccttcaagcagaggtgataacatgtgggaaagcaaaatgccagtgcctggaagtaatatgggatgttctaggacagaagtgggcacactaccagtgtgacctgctgtagcagttccagttttgtaaattaagttttatctgaagacagccatgcccattcatttacctattgtctgtggttgcatatgtgctacagaggcagagttgaatcgtggcacagttgaatctttgcagagttgaatagtttctgaagaccatgtggctcctttgcaaagcctaaggtatttgctatctatccctttacagaagaaaatttgcataaaaaaattagctaggcgcggtggtgggtgcctgtattcccagctactagggaggctgaggcaggagaatcacttgaacctgggaggcggaagttgcaatgagccaagattgcgccactgtactccagcctgggcaacagagcgagactctgtcgccaaaaaaaaaaaaaaaaaaagagaaagaagaaaatttgccgacctctgcggtgggatgtaaaagaaagctaagatgacaggaaaaaagcaatgcagggaatgatg

SEQ ID NO: 138445 - DNA, 1078 bp, Homo sapiens
ctggctgcaccttcagctaaatgcgcttcagacctaatatatctgagcataattatctggactgatataaatttgctgtacccagcacttttaagcattgatgctgtcagctttaaagcacctactcagagttctgagtggtttctgtttggactcaactttgagatccaatgagtgatttaggtgaaagagcaccactaggctgaaaaaaaagggaaataactttttttgaactcttatgagctaagtcctgtattttgggctgtatatgtgttattttctttagggccctgtcaacaattttgttatccctaacttacagatgacaaaactgaagatcagagaaatgaagaaacatgcaagggcacacagctcataagtagtaaatgaggtgttaaaatcctggtctattggtttcagagcctttgtgcactttacattagattagtaaggccaaaattcagtcatttgtaatttaggtactacctctaatatcctatgtgatttttttcttttaatcatctgttaaattaaaaactttagcctttccttaagcaaagatgtcttgaaaatcgggtttggggtgtgtgtgtacattattcatctgggtgtcgtttcagatcaactcatgtactactaatggaacacatgtcattctttggaaatgctgcagtttaccattagtggaagtggaagggaaaagggaaggcaggtaggtgcattctattagccttccacaaatcaaccacaattttttttttttgagacggagtctcactctatcgcccaggctggagtgcagtggcgtgatctccgctcactgcaacctctgcctcccaggttcaagcaattctctgcctcagcctcccgagtagctgggattacaggggcctgccaccacgcccagctaatttttgtatttttagtagagatggggtttcactgtcttggccgggctggtcttgaactcctgacctcgtcatccacccgccttggcctcccaaaatgctgggataccaagtctccacagctcacagcattgggaagctctgctataatctaccattggactggcttt

SEQ ID NO: 138446 - DNA, 1047 bp, Homo sapiens
gtaaactcattctttcatttgaaaaacaaactattccacaaaacagtaaggcttaatatcttaattagcagatgcagataaaattatagttatatgaaatatctggttgcaatgtattaaatatctgttgacagtgtatttctttctttttcaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtatttt

SEQ ID NO: 138447 - DNA, 1026 bp, Homo sapiens
agctttcacttagtgtaagcattctctcctgggaagcaggatatctattctggcagaccctaaaatttaatgaatgataatgatgtgtgaaaggaggcaatccagttttcacctctttgttgccagattcacgcacactagatttgaggacatggcaccaaataccagttttgggttcagtgctggaggaaagtgtcacaactttgcagggtaaccagcctaaactggtaggttagctaaactgtttcacctggctgggggaattaagtcaaacgtgaagatgctaatgaccatacatagcctccctgttaaacctaaatgtattctatggtaagactaatttcattaaaacctactcaagggagtctaaataggtctattgatctatcttgttggccatagtagctaaaggtaatggataggttcctgaccattgtctctatggtgaagacgctgattttagggagttgtattcatgctgctgtatgaaatcagaagtcaatgtacctacttgggtaggacaattctctttacttagtggtccactaaggggtccaggggattgtgttgctatcgctcattaaaggtggtaataatataataaaatgtcatacacatccccaatgtaaagatgttctgtagccaactctacaacatataaaacataaaactcaaggtgacacaggaccctccagtttgagatttcatgttacacttgatttggatcagctttacagtgatttggttaagccacaaagccacaatggcagtgctactgagtagatacaacattgacagccattcatgaagtactccaaggctactaagacatcaagagatagacgtgaattcccttagcatgtagatggggattgcaaaaccagaaacaggtcaaataatcagctacttttgctacttgactaaagggttgttttgccatgctggtgtgctgaatccaaggaaaaaaaatgttgatttctcccaatccttgcacttctcaaagtcacaaaactcaaatctaggtgc

SEQ ID NO: 138448 - DNA, 1040 bp, Homo sapiens
ggaaagggctttattcagctgggagcatcggcagactcacgtctccaaaaaccgagctccccgagtgcgcaattcctgtcccttttaagggcttacaactctaaggggttctgcatgagagggtcgtgattgattgagcaagcactgggtacgtgactgggggccgcatgcaccggtaatcagaacggaacagaataggacagggattttcaacgcttttccatacaatgtctgaaatctatatataacacaagcagttaggtcaggggttgatttttaactatcaggcccagggtgccgtgctgggctatctgcctgtggattccatttctgccttttagtttttacttcttctttctttggaggcagaaattgggcataagacaatatgaggggtggtctcctcccttagaagcagagagccctcaccagaatccaaacctgtggtgcctagatcttgagtttctccatctccagaattgtaagaaataaatttttattgtttacaaattacccactctgtggaatcttgttacagcagcccaaactgacttggacaccttctctctggatgaaaagatttataatagagatttgaccttacccaactgtgggaatggttaaaacaatccagatttagctgcttgtttagaatctagtgctgaccctcaattcataagacatggggtcagaaaggaaaaatgaatattaacttggaaaatgtaaggaaaaacaacatgcaaacaagatggaaactatatctttctctcactggaacacatatcagacgttctccatcttcaagccagcaaatttactggcatgcatgacctgcaagagaaatggaactcttggcacaaagtcctcctgaacctggaccagaaattactgaagcttgaggaataggatcctggtagctacagctgtcgcctttgccaatgaggtgaaccagcagatgcacaaaatcgcttgtgagccacaagaggtttcttgacctatgccatctgtattagtccattttcatgctgccaataaagaca

SEQ ID NO: 138449 - DNA, 1042 bp, Homo sapiens
aaaggctatatactttatgattccatttgtatgacattctggaaaatgaaaaactatagggacagaaatcaaatcagtggttgtcaggaactgacagagatatggattgactacaatggggcaggagggaacattttggagtaaaggaaaggttatacagctttctgtattggtagttacatgatggtacatttttctcaaagctcttcaaactgtacatctaaaagagtgaatttaactctatgtaaactatacctctttaaacccgggtcttaaaaagtcattcaatcagaatacgaccaatataagacatttgtattttactgtgagagtaatccggatacatacatatagggattttgatttgtactttgaatcaatgattgccaaagaaggctgtgggttccacaagatatgtttaaaaataccctctgtagtgtagaaataatatgttaaaaatgtaaattattttgatctcttttattaatttttattaacttgtacttctgaattgctttaaaacatggggggggcacctacaacacgtgacttttgatgcagttatataactttgttaaaacacatgtcttcattaattatctctttcattgagagttagttagtacaggacatatgtcaagaaaccagatgacatcagcattgtacagtacatgaaatttatccccattggcagagtctctaaccacactgaagttctcacatgccactaaaccatatgagtggaaagagaggagggaaggaaggaaggaaatggggaggaagaaagaagtagaaaacaaaatgctacaatctggagataatgatatagttaagaatatgtacccagttaaaagcagaagctgagtaacgtatgacagggaaacagagtggtcatagaataaataaatgtcattattttagtgcataaggtccatataacaactataaatagtccagttagaacactcccaaagacaatgaggaggccacagacattggtaaagcaaggaatcttagacatttcatagatattcaaaatatt

SEQ ID NO: 138450 - DNA, 1045 bp, Homo sapiens
catttacagacaagatgatgtatgtagaaaatcccaatggagctaccaaaaaaaagctatgaagctatgagacctaataagtaagtttaataataatgccagacacaaagtcaatataaaataatttattttatttctacacaataaaatttggaatttcaagttttaaagagtaccatttgtaatatcatcaaaaactgggaaatactaagggaggataactatgtacaagatttgaatgctgaagacttcaacacactgatgagataaattaaataagacctaaataaatagagaaatataccatgttctttgactgaataactgaaatactaatttttaggatgttatatctccccaacatttctgtagaattattgcaatctcaatcaaaatcccagtaggtttttcatagaaattgagaagctaattccaaaatgtatgtggaaagagcaaaggaaccagaacagccagacaaattttgagaaaaaaatacaaaagttagaagattcatactacctgatttcaaggctatggtaattaagacagtttcttattgacataggattgacctatagatcaatagaatgcaaagagaccatcaaatatagccaacagattttggacaaaggtaattaaatgaagaaatggcggtcttttcaacaaatggtacggaacaactggacatcacacaccaaaatattcttcttgacccctcagctaagaagatatacaaaattactcaaaatgggttagcgacctaaatataaaaccaaaaattataacttgtaaaaaaaagtagaaaatctttaagattttggtctaggcaaagatttattaggatttaaaaagcatggaccataaaaaattaataaattggacttgaaaacaagttcttttcaaaaaataacatgaaaagaaaacccagattgggagacaatacttgcaaaacacctatgtgatgaaggacttttatccaaaatatataaagaactctcaaaattcaataataagattattattgaataaccaaataaaaatagtg

SEQ ID NO: 138451 - DNA, 1524 bp, Homo sapiens
gcaggtatcctcgctctcttctttcaaagctttgggcataatgagcatatctgatgacaaaggtgacaaaggtggagcaaacttttcatctttaacacatgcactttcctctttgactgcagaatgcacagacataactgctgagatatcaatcttattcttgttctctttttcatcattatcttccgaaagtgaagggaaagtctcgcaccagctagagttttgtaatgactttgtttccacttcacttggaatagtatcgaccattgtgggtgcttgtgatttatcatcatacagggaatcatcactctctgaagatgctaacaagcatgctgagttttccctttcctcaagacaccctggtaagtcaccttcatccttccggtattttttatgagggggtgaatcggactgtttttgtggtacattttgagacagcatagtgatctcctcttcatctgaagtgcttgcttgactcaaatttgttctctcattcagaatacccagtgccacttttagtgatcttccataggcagtttcctctgtaggtggagcactgtcctctgactgtagtcctaatgaggcagcaatggcttcaatttgagatttatttaggatctttgtttctgtgctgtccaatttaattttttcatctagtgagagtatttgaacttctagagaaaatgcctttttcctcttactgtttgatgaagtttcagatctggacaaaacttttgctggccacaactggtctttccagttgcataggacatactcagactccattatggtttatatttgtgtgccaagggttattaccaaaggttgaggtggctatctttgtcactgctaatgcaagttctacccaaaacaatactcttaacaaatcctctttcgtcttatgactacaaagggtttacagcttgtgtggcctgttctccacctcaattttccaaggatgcttgaacacgttgtttgaataggatgataccggaagatactgaaacagggaaaaggaaaagaagaaaagtatcagcaaatacgattatttcgccaaaacgggaggtgagcaattacaaatggagaagggataaaagaacaatgtgcagtggggcatgagacagaggaggcagcataatataagattgcgggggggaggggtggaaaaaaaccagaaaagttgttttataatacctcagattgaagaacttgccctcattattgaacatgcttactaaggagtgaatgtatgtacatggcagcagaggcgggagagcttgtgatgggatgtcaggaactctatgtaattacatactttggtacttttgtgtccctaatgtcatacttatagcagtgggtctccaaacttaacatgtgtcagaatcatctgaaggacttatatttctaggccccatcatgagagttttattcagaaggtttggcttgtgctcaaaagtttgtatttctaaaaagttctcaagtgcctctaatgctacatgtttaaaaagaactctttgaggagca

SEQ ID NO: 138452 - DNA, 1044 bp, Homo sapiens
ccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatt

SEQ ID NO: 138453 - DNA, 1034 bp, Homo sapiens
ctgaattgactttaaacttcatctagccacttctccacactctcagaagcaagatttcccacatctctagcagcagactctccatttacaagcatagtctttctgtctctgtagtttcagtctcttgctgtaagtttacgccctgttctacttcccatcctatgtccagctatgcttctcaatgtggtacattagaggttctaagattataagatcacatttagatagaccaataataaaatggcaacaatatggagatgctccaaatttgaaaaaaaagactatttttccttatgaatttccaataaataaattccaaaaattaataacattattctgcttttgtgtgaaattaaattaaaacccaaaaaaacttaaagtcttgcactgtatctttttttctatttatttttggccaaaagtgtccctgatgcttggatggtgctgagcttgcttcagcagctacattctgagatgtgtgctgttagaactggatagtgcttttaaggtctcagaaatcacaggaattttacttttttttcacatacaagacagagcaggacccaagagatttgatatctatactactcattctttcaattcatttaacaaatacttaccgggtacctcttatgtgccaggcactgttcaaggcactatagatggaacagaacaaaagaaaaaatttctatggtcctgaagctggtattctagaaagctcttcatgggtatgagtaaaaaagagaagcaacttccagagtttaagacaattatcctatgccaaattatgttcccagaacatagtacatggttgttgccaaagaccatagcagcaactgaatgttatatgatgaaaggggggtacacgggcaaaatattggctttattattgccaagttgttttgatgataaaacctaatcaattcagtgcgagattcaattctagagttccaaaaaaatgttgattctgacagtttttgctagcatctttattgcccctgtgggttgacagatccttggagttccctactcca

SEQ ID NO: 138454 - DNA, 1197 bp, Homo sapiens
acattttctgcccccagaaccaagactgggatatgactagaacctgaatgccagaaccctttcagaagtgaagggtccattagtgaggaaaattcagtactgaaatctacccatcataccttaccataaatggtcaaatttgaagccctccaattggagcctgccaagccaacatttctagtacatttccttgtcctccaaccccttaaaatttgccccagaccccaaactggggagacagatatgagctgtgcctcctgtctccttgctggttgacttctcagtgaagcctctttttttcttcaaaacccggtgccatagtattggcttctgtgtgtgtcaggtagtgatcccactgctcagagatagcctcttcttcttggtttcatttacagggagtattttttaattccacagagaaacctctcagtttagcattccctctaacagttctctctagaaaactcacaagtagtctgtagttcaacagaccaactttcttttaattattctctctcacttcttcctttccctataacctgaaagcctggagatttcataatgcacctgtaactgtaaatgactcaggcatgaagcttgaagcttagaaaccaatggtatttcctcctcctggaggaccatccttataatgagaaacttctaggtatgtgaactgagagtgtggttctttcagcatctgtcaatatctctctgctgtgctcaaaaatagcattgaccattgtcacaagattattcattgcattgcttttataacaaaacaatgaaaacaactcaaactagtgccattagaggggatagaataagtaatctaaggtctaggccaaagtggattatgctgtcaaccaaagaatgagatggatctaaatatattaacataaaaaaatcagatgcaaaaatcagatcagccaacaaggaaataaaatgatactgttaatttaaaaatcccatatggatggaaaacaatactttatattcttctcttacaacataaagaaatatacatatccatagaaaaagggttttttttttgtttgttttgtttttttgtttttgacagagtctcactctgtctcgcctgggctggagtgcagtggtgcaatcttggctcactgaagcctccgcctcctgggttcaagtgtttctcctgtctctacctcctgaatagctgagactaca

SEQ ID NO: 138455 - DNA, 2215 bp, Homo sapiens
gtagctggcagtttctctcaagttacagggggatcatacccagcttctccaagaaaataactcatggcctcaaccacacacaaacagaaacacactaaaaaacataggcatagtgatgctaaacacccaataggcttgttatatatgcatatatgccatttgttttgcctgtaaatatccttgcaaactgtttctatgtctggccattagagagcatataccagtagtcatagaaaccagaatatcaccataacattcagttttacattagttttccagagaaactgggaaatgtaattcatcctctcaatcaatgcaatgaatgaataaattaatgcaatattagaagacattatgctatccattcccccaaaattacctttggagtgaaataagaggattttgaaacaatggttaaaatgaaagaacaaagagttaattattatgagttttctgtcagacacaccaaatctggtctcagtctctgtccaggaccactttagaacctgaaataacagatgcttatgctgaaactatctataaatccatacagtttcaaacgtggcccaaacactcaatagttccagatgatgtggttcacaagattaacatgttctgtctattgcaccttaaattcatcctcagagtcagagctttgcatcacagctcagtggttcacatatgactcacagtagtaaaattaaatgagtgaataaggtagtataaaaaatgttagaatctggacattgagatgactctaatgaggaagtaaaatctaagtaatatgtaagaatgagatttttcctctaccaaagtcttcgttgataatagagatacccgatacctgactatagcagtccccaggaatataatgaggccatgtccaaggacctttggcaattttgggtcaacatgggaaggagaaaatttagtgaatatcaaccctccagatatagtactagggaaaccagccactgaggagttgaggtaaggacactggaaacatttttggacaacaaatatttatgaagatggtattatgaagaaaataattccagaaaagatacactgactttcagttccaggacaaagtggtatagagtgactttacttgcactttccctctaaatgccatgaaaataactcaacacagaatcataaaagggctctgaaggtgtaaggaagaagttgacaggccaaggaactcaagacatgaggaaagacaccactgagtcccttgacttctttttatctctcatatattcttgcctgggcacaagagagtcctataaccaggaagctccagcaggcatggaagaaaaacaacatgaacaaaaaagcctactttttctggtcaaaggcattgaaaaaaggcaacccagcaaagacctagcagggagatccatactgcccaacaactaaagctgtggtggttccgtgtatcacagtagtagcatcagcagggcccagccagggatgtatcccacagtccatgcatggagcagtcgtgaattagtccacaacaacattagcgatcaaggcccagtgtttcattaattccaacccaatgacattaggtgcataggtggcacttgcagagatcaagtgggagactagcagagccagaactaagtcaatcagaaaagcactgacccaggctctggataccaaatttccatttgaactaaaggttacaaaagttggccagtatacataagctagacctaaatatggtgactgcttgttgaagtttaatatttatatagaatcaagaatctcctaatataagtcaaaatgtccagaattggatcaaaaataagtcatcataccaagaaccatggaaaacaacttgaaagtcattacaccaagtaaaataaaccagacacaaataaaaatactgtatgatgtcacttacatgtggatctataatagttaaactcacagaagcagagaatagaatggtagttaccaggggctggggggtggtgagagatatagcgagatgttggtcaaagggtataacactttaaattataagatgaacagtttctgggaatctaatgtacagcatgaatggtgatggatgtgttgattaatttgattgtgataataattatatgaagcatacatatatcaaatcatcctcttgtacagcttaaagatatacaatctttacttgctaattaaatactttaaaataaaagaatagataaac

SEQ ID NO: 138456 - DNA, 1111 bp, Homo sapiens
aagcaaccctgttcttcctgggatacacagaagtaaggtcaggctgggacaagagtcatgcctgtatacaaggtaagggatagttttcagcagtttctctgcgaggagaaaagcaggacagatatcttgacgcacattcgggctgtcatagtttcgcacagatgtaaaatactgtggtcattttgtgggttagttttccagtgagagcatcattcagcaaggtagatgaggtttcagtgtagctctgctacggaaagtggtgtgtgacattaaaattatccttagctgctctgttttctggtctctctttctgaagaaataggcaaaatatccacatctcttcaataagagggttgatagaaggacaccaaagtgcacattgtttcatctggaatacaaaggataaatacgggtgacaaaggtaggtcctggtcatctgaggtaatttctggtaatatggagccacacaaggtccatgggaccattggatttcagtctagaaatgctgggttccaatgctcagaatttaaattcccaggaaataaatatttagatacttatcttcactttttcacacaccgcatggtgaagagaaatgagatttatcgtgcaccctcaattctacaataagaaagcaaaaaaagaaagaatggcctgtgaggatttgaagagataccttcatcagtaataaagaacatgaacgtggaaggccttctatattttaatgtattccaaacgccaaaacaaaagaatgcaaacacaggattggcctgtgtgtgaggacagcatcactgggagggaacttgttggtgtccaaggaaatataagggggaagtggaaaagtcagatcgccactggggtttgtcagctatcaaagcaggctatgtctcttccctgcattcatcagcctagcaatactcgctaaaattgttttaaaaactaactaaataaaactgggcaataatttttgttgtcagagtttggatctatagttccagaatttattctggttttctctcctcatttctacaactaacagaaaagcttttatttaaaaaaaatcacaccagatttcaacataatttattgtttgtatttgtatatgtcatag

SEQ ID NO: 138457 - DNA, 1040 bp, Homo sapiens
atagggtcagattcctcatcagattcactgtggggatttgtttggaaccgacctactgcatgcttggtcgtgaagggatgccaaattccacgaggccccccaccaaaccacctctaacactcagtgctcacagctgatccccaaactcaaggatggggcggaggcatcggaaatatgtgtcagaagccctttgctaagtgtctcaggacactttctgtgtgaagaaggctctgatgtgtgcctccgttggccagcaatgacccatacccaattccactaacattgtgtcaagacagctcctcatagctgatgcacagaaggtgcagtcaattgcccaaactgattaattaatcatccctactttcagccataagtcattgtagcaccagtcaacagagaaactgcatggcatttttgagtcgaagatgaataaatattttccatgacacattaaatttatcatcagaacatctgcatcgaacaggattgagaaggctcacttgagactcacattgttattaccaaacaaatgaagtggatgacaacatgttagaacctgaaattgtgatgacttattcagaacacagagtcaaggcaacacacgggaaaagattttttcctctggacaatacctaagttgcaatcacagataccgttttttataacactctccagggctgtcataagttggttggtgtggcggaaatgcctgcaaactctcagggccctttggtgaaacgtcatggcaggaggaagtagagatgtcaaactctccacgcacagaggaaggcaagccccacattgagttgctgcctgggccaaaacacactggtcaatatttgtaaaactatgtatgaagataataggagaggagaaagagtcctggcaagagattgaactcccacagagagccccgtgtttggcagtcacggacaaattaaggtggacctgtgacattttggaatttgcttccctcaggcaatgctgcaatctacatactgccaatgaataaagatgttcagttgcatggctcttacaga

SEQ ID NO: 138458 - DNA, 1113 bp, Homo sapiens
ttggggtgtgtacacaggcctaaggtgaagcatggcacagagattgggagtgctggaaggaattcccatccccagagtagggcaaaagaaaggaagatctgagggttgtgagaactcataatgaggtaggacggaaccaaattgctgggaaccagacgctgagcaaagagggcagcccagataagagtgcattttaaaggggcaaagaggaatgaccccaggaacctgggtacttacatctgagaaagggtagctgcccgataagtgctgagcattaggaccttagaggaggcttcctcagggctgggactcagactttgaacagagagaggccaccagcaggctactctgttgaatgacctgagtgggtttgatgcatagtgtccctaaagttagaagaaaatggcatctgttccttcataccctgaaaggaaactgcatggcactgctggatgaagagcatttgttggggtagcaatgctagaaagaggaggcagaaagggagttacaatatgcttccttctctcccaggtctcctgtttccaagtggccttatcaaagccgataatgcccgcaagtccaagggaccagacccaatagggagctgggtggtcaaggacaaagggtattgccagagatggggcaatggcattgatgcacactctaagaaatgttgaactgagagattcagatatccctgacctaccatttgccgcttcttaaggcatatttcatacaaggaagtcagcaataagttcccaagaaactgtgcatctgtttcaaaccattattgatagatagaatgagttaccagccccatcatcaacaatatctactagcaggcacccaaaaagacataaaacagcctttactaaggagcctgtgctttctgtcacaagtacagaaaagccatagagagacacaacttttcttttatggagccagtttgcaaaggaatgctcagctacaccagccatcaacaaatgatgatgtattgggacccagaaagataacatgagatttttccacacatttaaatcttcaatcttttatatcacgggtcagcacactacagcctgagggctgcatctggcctgatacatgctttttttc

SEQ ID NO: 138459 - DNA, 1230 bp, Homo sapiens
tgcaatgtcatgggtttgctcaaatgcgggtgctggtgcttggttaggctaataagtcctgagggagggggcacaacaaatatagagtataatatagcacagagtaaagccatgccaaactggaggccttccaaattttgagtctgaactacttaaagactgtctgaaataattttgtcaattgattttactactaactaggtggaccctgtattgatttcctgatcatcaccaaaattcttcctttccctcataaccacttgtagtgagttcgagcaatttaggggctgatcagggaaaaagatatgacccaaatgtggcattagcacacagcgagctttatttggatgacactttcacaggtttgcgtgagagagacaaccctcacaacaggagaccttccagaggcaccacccagaaaagggtatggaagagggcaagataatttccaggaaagagtggaatcagagaggggacctgtgtgtctaggtgatgtcactcagcagcatgatgacagagtctctgggtcagagagtgccaaagaacagcggtgacttggggggtctcttatagctataggctttatcttagctatggatagcagatgctgggtgctgttttgtggagtatgcaaaacaggcaggatctccaatggctacaattctgcttatttgggctatttttaaaataacagaatgtgtaaaatttgagttttgtgccagccggctttcaagctaatggatcctagcctgctttgaagaggtaaacaacaaagggccagtaatatagaggccttctttggctaatttatgtaacagtgcccatgttggagagtgaacatatgagtttgttcaagtatgagtgtgttaatttgagtacagttgtgcaattaagtgtttgtgcatgttcccatgtatgagtgaatgtgtgaccaaatgtggatattagcatgtacgtgtcagtgaatttgtaaatgttttatttgtgtgatatttttaatgtatgagtacatttgagagaatgtgtagcatatgtgcaagagtgtgagtgtgtgtgttgtgagtcaattcataatcatggacatggattttagcatattcatctgtgtgaatgaatgtgtaaatatgcttgtgtgagcttgctgaatatgaatatatcagtgtaagtgaatgtgtaagcatgggcatgtaagtacatgtgaatgaatgaatgtgtgtgtgagtgaatgtg

SEQ ID NO: 138460 - DNA, 2018 bp, Homo sapiens
tgtaccctggtcaggttcatacaggagctttattacttccttgagaagtagggtagggtggtgaggtgaggaggaggaggaagagggagggaaagctagcaaagcttcttctctgtgggcaagagaactgggttgccacagtgctgtgaaaaacagttccctgggggcttcacttagcacagtacctggcatgacataagcatcccaatattgtagggtgaaggaaagaatgaaacattttcctccattccttcattcacctgttttttgatcactgacactgtgatggatgctggggagggaagtagttaaccccaccacttttcttgcctttctgaactcatcaggaagcacagtgatacagggctaaggccatcactccaaagatggcatttaggcatcttatctggaggcttcttttttgattatgcttttagagatataggtataccttagctaagttctcatcctgatcacagctagcacgtaaagtggctcatctgggcagataaagtagaagtattctttcctctggtctgcatctctgtgccagagcacagggcttagtgaaggtaatgtggcctgtgtttctgctcccacttgctctttctgctgggaaccttcagatagggctctgtgctggccctttagggtaccaggattccactgaaagggaggagttgcttgagtggcactgaatggtctaggataagaagtctgatcctgggattggaggaggggagggggctgcctggcctcgctgggatttattaactgtataacacagcctctatcctctaaaggcatgtggggagcctgaaaggctataatcaagaactgtgtttctagaaacctgtcactgcatagcgctttgctaggggttgttcacaatagccctgaatgctggagtctgggctgcgccctaacacaggcacccatttacttgtcagttgtcattcagacacttattcccaatagcacttagctttttgaagcattggggttggagtacacatttctctctttgcagctcagcttctgggcagtaagcctgcaaagaagccagcaggctgaatgatgagggtcacacatattttcatagcaggagtgtgatgtaatacacagagaacaatggccttgctgtagagctggttataggcagctttgaacccatagggaataataaaaatttatttgtgcacaccaccttaacagtttacgatacactttaaaatccatggtcatatgtacattttgccagtggacagtgatagcacagaggcccaaagaaaaacctcaagatgaagaaacatactcagatacatgctcacacattcagtcacatttgcacactaaaacaattacactcccatgtgtgttcacataactcatacatgaatacagtcttagattcacatatatgcctgaacatacacacaataacatgctcacacacacattttcacttgcaagtgaacacattcaaacatatgaacttacacacatattgagacactcacatatgcttacgtgctcacatcttcgctcacacatgtatatactcacatattcacttaattaacttattaatattttaacatgctcacacaaaaaattatcatgaatcaactcacaaaaaggaaaatattcccataattgcacaactgacattcattcacacacacagacgttctcaggcactcatgaccacaataagatataatgtgctcacaaattaactgacaaacctatacacacaccctatacacactcacagacgtacacatacttacatcacctcaagctgtacatgatcacactcccacacatgaacttccttatgcctttacatacccatgaacatgctcacacacacatcatttactcagacatgaatgaatttcacatattcactcacacaaatgagcttacaaatgtattcacacagacacattcactcacacacattacatgctcaaaacatcaactgcaaacacttttatctgcacatgcttatg

SEQ ID NO: 138461 - DNA, 1022 bp, Homo sapiens
cgttcctcgcctgtccgttttttataaaacgacgcgacacacctagccacacagcctcagatcctattctaacatcgatccatcctgttacccttttaagaggcggatcccgcagtgtcctttcctccctcccagccacctctacccccagtcggctgggcggagcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgagtgcagctactagattgcacccctccagacctctgccatggccagtttctcttattttcctcattgccctcctcgtcctatccccttgctccgaaggaaagtgggtgctctttctgtccc

SEQ ID NO: 138462 - DNA, 2734 bp, Homo sapiens
ctctggtggaaaagggtaaaacaaaccgggtgcagaggctggcaaatcaaggactgtttgagctctttgcgttcccttttcctggtttttcacaagggtgtctagccttggattaagtggtggtgggcatcgggtcttaaatgaccgaggagatcacctggaaatctcttcctcactctgctttttaacaacctcagactggcagcagattttcccctcctctccctgtttttctctccatgtttcctgggtatcaaatactagattgtgctactgtgccctgttaacctcattgcaattttggtggaaactttgcttagttcttgggttcttctctgcccagtggtctcaagtcccaagtgacttggtatcagtgcttttgtttgcttctgaaaaatctgatttaggttattgagttgcaaaacaggtgactaacgttcttgaaaaagaagaggtttctgcatgaggatagcaaaggcctagactttggaaaaaaaaatagtccaggtagttcttaaattcttggagatggtatgaggttactatttttccccgtcggttatccttccacaaacttccctatttgtgattaggtatccataccttatgtatatagttatcctagaccctaaaggacaaaggggaaaaaaatggagaaaaagaaagagacacgtgtaatagcagtgtatcatagtttttaagagctgggcctcaagtcagagcttggtttaaattcctactctgttgcttactagtcctgtgaccttgggcaacttatttcaagtcttagagtctgggttctctcatcagtcaaatgagaatgaataataagaaaacttatccacaagtttgccttcaggataaaatgaaataatgccttaaagagtttagtgcagtaaagcacatcatccactctcagtaagggttagctgataggattagccttctgggagtcactggaaggaagaagctgcttatttgactactggaggttttctgtttttcttaaaaccttatgactgaacctgcctagagagcacttgtattgagtggctggatggcgtaatggaaagaacactgaattggaactcaggagatttgagttcttttagccccttctttgcctctaccgactttgtaaccttgtacaagttactcacatgtcaaatgattgtataggcagtggaggccaagttagaagcgtgtactgaaacaaaacaaaagtagatgaactctaagatccctttcagatctaaaatgctatgatttttagtttttatattgattaaaggagaaactgtatctctcttggccgataattcattgattagaatgaatcagtagcttttagaagttactgaaaatcaagaataaagacctaataaagtttatagtctttatatttcagttgactgtctaatagcaagggtttgactttgtcttctaatgagattcatttgcatgaatgatttgtaattgaagagtatttaattacagagtcctacttagaccattttccttttacttctgttaagggtatttatctgatagttttaggagacaataaaattaacttttgcttggctcccactatatgccaggcactctacatacatattacttatactttattgagaggcaatatggtgtactaagaaaaacacaggcattttagtcaagattgggaataaaattctggatttaccacacaatagctttgtgtccttggtaggattatttaactttactgagccttggataccccatctgtaagatggagataatatttatgttgctgtgattattaaggattatatatatatatactacccagctgataatagtcactgaatgttataataggttaatgctaacaggatgcaaaaaaataatgtacaaatgtatgattgtgcaactgtcgatttgaagacatgaatacactgagaatctaactatgggtgttgtgtttcaggataccatataggaataaagccctaaatattgatcactaaattacactacattcagaaaagcattttgatactttaaaaacaatattatctgagataaaggctataccaaagtttgccatcaagctaactagataaaaccagcaaattacttgaggtaaggaatcacatttctccttgaactcctggaaaaactatttttcaatatagggggaaaatcactgcatattatccacatgtgttattgaatatttgtttgcaaagtgttatattgtttgctttactcattcctcagagtaagcctagggtttccttttaacctctggtcaaaaacttatcttggatcatagtggcagagagataggactgagatttaagtatggattagttcattatatattgctgtgaattacgaaggggccaccaaatgtggaaaagccttctgtatcttctttgtttacaaaatctctcttcactcactctcataggggcctgcacttgaattgtttgcccttggttagagtttgtgctgagtgtctatattcccacctaactaatttagaacagttgctttaaaatttttgtttaggagaaagaaactccactatataagagcaatcaattaggaaaatgagacttttatgtataccaaaatttttcaaaagttaattgtagcctaacatcaactcatgcagtttatttctgtattttgtttgcagagtattcagaaaattctgattcacacagataaataattgcaaatg

SEQ ID NO: 138463 - DNA, 1033 bp, Homo sapiens
ctctcgagtagctgggattacaggcctgtgctaacacacccggctaattgttatagttttagcagagacagggtttcaccatgttggccaggctggtctctaacgcctgacctcaagttatctgcctgctttagcctcccaaagtgctggaattacaggcgtgagccacagtgcccagcttatcattttattcttttgctctgtatatagatatattatttaaagaattatatactatatatactagttttgtatactgctttctattgtaagaatttctccatgtatctagaaatagaagatggtcctcttgtagttgaaggttgtggtcattgactgagagttggggattgagcctctctttctttagctaccagaaaggaagtgaaaaaatggagatggggagggttgtgaattggggcatttaaataaaaaatatgcttcaccgaggtttacattgaaatatacttactagccttaaacatggtctgatctaacccatatgcattgcctattgtggccttggtatttcttagggtttgatcaccacttgtgcttcagttcattttctcccccaatattcccataggtaatgcctttttatttttctttttttatgtcttcttcacaattgaggtttgcacctggtttccctgttgcttttaagtagcttttctattataatgatggctactgaactataaactattgttggtgtttaccccaaagtttatttgataaggcaccataggtatttcctgggaataaataatttttgtatatgtaagttctatcgaagtataatatacatcccaaaaaggtacataaatcattgatttagctcagcgaaatttcacaattgagcacacctgtgtgaccagcgccctgctcaaggaataaaatagtaccaaactccagaagagcacctcacgctccaatatgaagaatttttgatgtagcacaattatcaattttgtttcctgagggaatgccctcttgcagcatgtggtaggagcccagtcacccacagaaa

SEQ ID NO: 138464 - DNA, 1052 bp, Homo sapiens
gccctattttctacaatttgggggactatttgtctttaagcaagccttcatataagatgcaaattgggtctcaaaggcaatactgttgaattatagatagttaatctgaggagggggaggtgtttgttgtatataatagcttccttactaagttatgagttccctaaaatcggtaaccaaatctcatgcgtgtttatataacctacaactttcatatagatagtaggtgctcaaaaatgttaattgaatgaatgggtatccttcctttgtctcattgagacccatttaaaatcattttagcaattgggttattatactaagaatgtttcaccaaactaaaactgaatttgttttattttacaggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcaggtttgtaatggtcctttcttccactattaaaaaaaatttactgttctaattgtagtttcagggtcctgcattttaatacattgtacttgctagacaatgatctccccatatgttttacaaaatctggtagtttttaaaagtatgtcagctcttctcaaaggtttattttctatatttgtcaaagaacttaatcctacctgattaaattttctaacacctcattagagaacacatccagcatttaattacatataggtgtaaatacatatgttcttttaaataaacatttttttctaaattacaaaaacatttcatactcaatatagaaaacttagaaattagaaagtacacgggaaaaaaactcacctaaaacctgatatagcaatataactatagtcatcgcccaaaggtaaccactattattttatatgtacgtctgta

SEQ ID NO: 138465 - DNA, 1007 bp, Homo sapiens
acgccctgggaccaaaaatcaggctgaaaaatcaccagactgaaacatatactttacctaattggatataaagacaccagtgaactaggtagaatatctttgctttcaccataatttcaaaattgaacattgtaataaagaatgatcattggtttgacattttatcatcaaccccaatatattcccattcagaatcaagaaaaaaaaccatgtagtggagattcttcactaactagagcgaatgcagcttttgattagtcagaatagtcacattaagcttctgttaagaaaattggccaacaaccagcttctttgaatcagtcttcagttctactgccaaatattcttagaccaggtatctcttaggattagagaggaggaggggaaaggcaaaaggcgtttgacatcatatacttgctttttaaaattccccaaatcacagtaaatagccagtttgggaagaattttaagattggataattgctggctttaaaggggtttttaaatttccttcgtttgtcttcttcacaagaaatgtgaagcctcttaaaggcttctttgccattacacaatggaggcagtgtacaatagtggagagatcatgggctttaaagccagatagaacctgggcttgaattgaatcacagctctgaagcttaccagctgtctggactttagtcaagcttctgaaccttacttttcttgtctataaaacttggatattaaaatagctatttcacaatgttgttaatgattaaacaagatgacacatgtaaaaagcttacaacctgacacatggtaaaggttcaattaatttgtaaacctttctttccccaaacttaatggagtagagacttttaataattgaaatgagaagtgtcttgcatgagaaaatcaagaaagtctgtttatattttctaaattcagaaaataatttttgagcaaactctagccactggggaatttttttctaagtgactaaggcccagtcctccagctactcaaga

SEQ ID NO: 138466 - DNA, 1814 bp, Homo sapiens
atgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaagtttgtgtctggtgttagtttaactatctgtattaggatgtttcttgtgtcactataaaggaatacctgagactgggtaatatataaggaaaacaggattaattggctcatggttttataagctgtatagtaagcatggggccaacatctgcttcacttctggtaagggcctcaggaagtttacagtcatgatggaaggctaagtggaaacacatcacatgacaagagcaggaggaagagagagagaagcaagaggtcccagactcttaaataagcagatcttgcatgaactgagtgagaactcacttatcaccaaggggatgatgctaaatcattcatgagggatccaccttcatgatccaatcacccccaccaggcctcacccccgacattgagaatcacatttcaacatgagatttggaag

SEQ ID NO: 138467 - DNA, 1166 bp, Homo sapiens
cttaaaaaataattattcaactggtgaaaactcatgctgtttgtgaacagttgtggaaggcttatggctataaggtaagctaaaaataaaaaataaaaagcagtcaggcatggtggtgcacacctgtagtcccagctacttaggaggctggggcgggaggattgcttgagcccaggagttcgaggccagcctaggcaatatagtgagataaaaaatattttaaaaagtaaaaggcattataatgtttgccacattgctgtacagctatgacagattttatattgcctttattttagaacatttgcccagttttccaccttttgctactgctatgtaagcacaaaaggtaagattaaatcctaaatgtgatggtatacaatgctttaattcaacagatatttaccgagtgccttttaaaaaacaagcactgttttaagtgctggagataaagcaatgaaaaaaaacaaagtccctactctcatggggctaataccgtagttgggggaggcaaataaacaaatagtatatgatatgactggtgctgataagcaatatgaagaaaaataaagtaaggtatcatgatagagaggggagggggttggtatattagagaaattggtctgggaaggcctcttaggatgagctgtggacagagacttgtggtactagaatatatgagccaaacaaatatttgggaacagagtgaatacatataattttttctagaagttttttctgtgaagggaaagagagaaatagggtggtagctggcccttgtcctgggtgttgagtatacagtggtgaataagacaggaatagttctggccaggcgcagtggctcacacctgtaatcccagtgctttgggaggccgaggcagatgtatcacctgaggtcaagagttcgagaccagcctggtcaacatggtgaaaccccatctctacaaaaaatacaaaaattagctgggcgtggtggcacacacctgtaatcccagctacttgggaggctgaggcaggagaatcactggaacccacgaggcggaggttgcagtgagccgagatcacgccaccgcactccagcctgggtaacaagagtgagactccgtctcaaaaaaaaaaaaaaaaaaaagacagaaatagttccaacccttacggagtttatcatgtga

SEQ ID NO: 138468 - DNA, 1087 bp, Homo sapiens
aggtcaccagtttacaacaggagactggagaagagaggagatgaactgtctgtccactagagagccataaagtcacagtgcggggtggcaggggggcgggggagtaggaggtggtgacacccacaggtgtgggagtggggctttccctgtccagagaagactagacaataggatacctaggaggataagagttagaacagctgataattctggaattcttgttatgaaccttacatggattaactcctttaatacaacaactttgaaggataggtacagttgggaaaactgaggcttagagtggtttttaaaacttgccccaaatcacacagttggtaaattgtggcaccttctaagcgtcaggctttttacacattttacctcattgaatccttatggcaaccctaaaactcaagcactattattttccttgttttatggatgaggaaactgaggttcagagaggttaaggaatcttaaggtcacgtaattaataaatgaccgatccaagatttgagagatgacagcaattgctccaggttacattaatggtaagtggcagaactagagttcagggctgcctgacaccagagccctgtgctttcaggaggtggaatcaacagggtttgctgaaggattaaatctgtgggagggcaagggagaaaagatttaagttctggctgcagggaagtgagtcagaggatatgaagaactctgggccaggggccaggaaacactgagggcctctgaaaggtgtcactgagggaggaatgtttggggacctcctgcccggcagtggcaggctctcacagcacctgggctgtgggcacagggctaccaggggtgagagggggatgagggaattctgttcctgcccctcggtgctgtgctgcctcagagtggaatgggccctggctgggcatgtctcactctggctgaaaagtgggaggaactaccaattgctgagctctcccgttctatcccaggcactgtgcttggcaccacacacactttatcctgaactgggtggtggtggtggtggggcatcctaatgtttacagataagaaactgggactcagagaagtg

SEQ ID NO: 138469 - DNA, 1016 bp, Homo sapiens
cttgttttgggtcctaagcacccagcatttcacagctcaaaaattgctcgaatccttataccataggttatagggatttaaaatccttggaatcccaatatccttggttttaaggtattatatagcatagtattacaaatccctaaatcctcagggatttaaagatcctaaaacccttggagcagtaattcgtaactcagaatgggctcttctcattttccaaccccgccctccttactgcacacttgctgttgtttactgggcagacattttgtctcgctgtcctctccgtcccctgtcctgaaatggcttccagtcctcttccccatacgtggttgctaagtcattggaattcactgttctgactaatcagagctcagtatgagttactttgttatgggcgtttccaatccttgtgccaacttcaactccagtgcacaaactcaggagaaaaatctctgtgcaaaactcaagagtccttcctccagctccatttggctggcccatcctagtgtcccagcacttccccatcctagcactgatttcctcctgtttctcccaccttgttgcagcagtgagagaacacatctgttggggtgaggctgcatttgagctgggctttgaaggatgggcatgagtagtaatggagggagaaaacttttcagaaagaggcagcactatgaatgccttcattaaacaatacttattgagcacttactatgtgccagcccttaacgttgtaatgattaggagcatgggctttggaagcagatgaacatgggttcaaatgccttttctgctgcatgctggctcaaatcataggcccactcccctcaagtgtcaaggtcagctctctgctcttaaccctttcactacaacctctatagttttttgtttgtttgttttttgagacagggtctcactctgttgcccagactggagtgcagtggcacttggctcactgcaacctccgcctcccaggctcaagcaattctcctgccttagcctcccgaaca

SEQ ID NO: 138470 - DNA, 1101 bp, Homo sapiens
gttctgttacaaaactttctttcttcctttccctctgacctcattgttgcagccaagagaaggggtttaggggccagcttctttcttggccctactggcccctctgcacatatgacacctgttaggggccatgtttcttctctgtccacaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccctagccttcccaggtggccatgtagtcccgtctctctgtggaaagcctgacttctggcttcaccccaaggaataccaacagcagatccatgcaaggttggggtgcctttttgatgagtcttacaggaagggaaggcagtgtgtagagaatcggcttgctctggggatgcctccccattttgcctgctgtccattgaagtctgtgtgttggcatgagatgaatcaggagaaaaataaactggatggtgttttcctttttcttggaactgtgctgatttcttaactgaactctgcccatattgtgaagccatgggcagaggttcagagaccagctcaaggccaattcattgcttttcctacctgaggtcag

SEQ ID NO: 138471 - DNA, 1990 bp, Homo sapiens
tgtgcataagtctttgatacgggaaggcatttgtgatgctgtaaaattaatgagttggcactgttctctgcatactcttctaggctttttatggcctttttattccattcttgtgttaggggatttggggtatgtgttttttctttgtcttccctcttgacttgcatctttaggatacttctaagtcaggctggtcgcaatcttatttttagaattcttaccaaggtcaacctagtcctattatatccagatgctgcccagtcacacctttcaacttcacctctccgttaataccagtcgcactagtgaaatggttgaggcttgtgggtaaagttgtatccctaacctggacttgtctgtgggtaacatctagagtcagtctgaatatgggaagtttgagttggggctccataggatcagaaaatacttaacttgtactctgacagcttacaatttaatttcctcttcttgcagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggttagggtaatacctcaccactaggaataagagaccatagtaaccaagggagcgggacattggtgccctgattatttaatgttctgaggcctttaaataaaatatgcccctgaactattctgtggtgtgtttcagatagagtaactgtagtaggcttcctgcccattttagggtattgaaaaggcccataagtagaggaatatgtatagtggaatcacaggatgaccatatgaggaacggtttttggcgtgctcttttgtggggtcattgaatttctgtttcttggactgcaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaaggttaattactagggtttagttatcagcttgtgagtgctaatgggaagcatcccttaggacccccacttactggccgtagacaaaggaggaagccttaattcacaggccaccaagaattgagtaattacttcttagaaagctgcagccagtctccctgtgcttggtggcgttgtgctttcttctttctagctaatgaaaacataactgttgagaaatgtggttccattttgaaggggcttcattttatt

SEQ ID NO: 138472 - DNA, 1046 bp, Homo sapiens
aactgagtatgcctgggttcagtgttctagtgtacattactgcacactgtttgttttgtgtaggaaacagtttctttttatttggccaagcattctttcctagcatcagaaggattgactcatcctttggcatttggtttgaatttgagacttttacaaatcatttctgtcttttataggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccaggtgactaaaaagcatgatctcttgtcaatagtaagctttagagtctgttttcctgtagagtaagttggtatgttttaccttgtttctgttttttctaaggcctagcatggaattcagaagtagaaacacaattttaagttgatagaattgtgtgttgcatgtacctccaatttttcagtattataactgctgtatcaggtctataattttgaggtgatcatttgctgatactctttttatgtatcatgtattcacattatattgggaattgtgcaagtgaaataatagacaaaatttgaaaagtgtaaaatactacacaaataaggtaatgttataatgataagcattgttccttttcttcagtatatggatattgaagttctcttgggcctcataggcctagcacatgttgaccacatgtaaaaataactattagatatttgtgccattaggtaagctttatcatttgttgtttcctagaataaattattagtataagtttagcattggactttacttgttcaccttctagcacctcatcagtgttattttgtgtcttcataacaagaagaagcataactgttctttttcttagatatcaggagtatttgaagcactgaaggatatgactgcccctttactcccatgggactgaactcagtactcctaattatgactccttgctttctct

SEQ ID NO: 138473 - DNA, 1033 bp, Homo sapiens
aatagttcttcatctgtgacttgagggaaggatatagacatagagtaggaacataaataggttgaaggggaataagagtttataggggagctcatatatgattactttaatcttttccatttagtgagaatctaatttaatatgaataaggtagagataaggaagagtttctcttaacaagagaagagctctgcaaaaaccttggggaatgatccagggggccaagatatttaaaaaattctgaattctaagtgtacagttttccagttgtgtgtagctctacattaggttgtaatctcgggttatggaattaaataggaattagtaattcgaaagttggaagtttttaaaagtaaaattcaggttttgatttttacaaattacatttttgttgaccctgagtctactgttgttcctttagggagagaaataaagagcaagggctggaactcagatacagcctccagtaacggctatgtggtagaatgttggagtgcttgttcatgggcaccataatgctactatgatcagcatttggatgaagagggactatatagacatattagagttaatatttgattgatttataatagatagggtatagtatttgatcatctgatttttaccttgttctgaattatctacctgtagtcatctgacaatcaaataactccccatcaacttatcaatatttggctctatcctatctctgcagtttggtcctctgtcatagtctctaatgtcaagttacccatacactccatgattcaacaagccctgaaaatttatagaactctactttttagcacttgtgaccatttcaccttttcaaccaaagtgactgttcagtgttacaactttgtcattttgacatgtagcttgcaaaggcaatggattcccatcttggtttcttaaagtgtagatgttcaaaaatatgccagatactctaaattattggtgtctgttaaatgggaacttctcaaagatcaaagaattgctcaacaagtgctaaactttgacatacttcttgcat

SEQ ID NO: 138474 - DNA, 1099 bp, Homo sapiens
taacgtttgtgggcctccctgactgtttctgtgggataaattcttaaaaagagaattacttggtcaaatattaagaatattcttaaagctattgcaacagatgtttaaatgcccgcaaaaaggttgtaccaatttatgtcccttggtatttgatggtttttgctataatatggtgtaaaattttgtcgttgaagcccctggtatgtttgtctccttaacgatgttcttctcagaataagcaggtgagaatcacctttgggttctcttgcaagaatagtaaccagtttggaataatgatgtatcataacaaccgactcataaaatcttttgagaaggtggggtgccaggtgaaggtgagtagttaatatttctttgtcataggaggctgaaaagagtaggaagagaatttaaaatttgcaaaggggataggctcattaatggcttttactcccatcttatgatgcttattgaattctgatcctggaattgtgttaccagtgagctgtcttgtgttgaaatctctttctaactctcattcttcagctgttaatcaacccaacaactttactgaatgcattttctaagtagctgtcaataagaggcagaattagaataccagcaagcttaccatgtgtgtcagcttatttgtgttttaggtaactccattttcttggagagacaataaggcatagtggaaggcatataaaatatggtggttgaagaccaggatttgggtcctgaattttccatttacaagctgtgtaaccttggataaattgtttaatttatctgaagctcaatttcctgacctttatgtaaagtggaaacaacaataataagcatacctgctttgcctgcctcacagcttacagggttgagagatttaaatgggataaattatgtgaaaatattttttaaaccactctatacaaattttaccatcatctttaatgtcttaatgattatttaaagtagtaatgtctacaagtatcccttttattcctattttacagataagattgctaaagcacaaaaaatgatgaactgcttcaacatagtaagacagttatataaagcccaggatagctcgttttcagcc

SEQ ID NO: 138475 - DNA, 1015 bp, Homo sapiens
tttaattcagatatgtacattggttttttttagacataatggtattgcacactgaatacactacagtatagtgtaagcataacttttatatgcactaggaaaccaaaaaatttttgtcacttactttattgcaacattcactttactgtggtgctctggcactgaacccacaatatctgcaaggtatgtctgtatttgcgactgcaaccccacccaacacacacaccattttaaggaaggatcaattaaatcaaaagactacgaatattttactatggctaaagtataatgggaactcttgtgttggctgcagctagtgtaatgagctccctgtctaccctccactctccacatactaatatccatttgttaccattgataaactatgagaagtgtttgtttgtttgtttgtttattctggggagaggaaccaaaagagatgaagaaagagaacagaggtgataatataggatgtgttcccagccctgtgtactgagtgaccccttgtggttagagaaggatgaacaaaccagaaatggcagggaacattcaagaaaggctctgaaattctgggcgtaagtgggttagctttagatctaagtcaacacagtgtaatacagaataggaaaagccctttttgcctattcttgggactcagtactgatttgataccctaaagagcgagcatttttgaagcatgcagagacagtttacttgacactataggtggtatcagtggtcatgcttttctgagtagctcgtcaggcagcagttgtagacaaatgggattcagaaaaggagaaaagaacagggtgactgctcagtgataactacagtggataaattagtttatatcacatgagagacatctctttgctgcagtctcccagtggacatttgtattacatacatatacacaggcacacatattcatggaaaactgtattgacggcatgagtatgtatatagaaagacaaaataatctacagataaaaactataataagtgaatttgg

SEQ ID NO: 138476 - DNA, 3037 bp, Homo sapiens
aaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcatttttttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagat

SEQ ID NO: 138477 - DNA, 1800 bp, Homo sapiens
acttgtttctttgaattaggagacaccctcaaacaccgattttgagtttttattgttattatttttgccattaatttaattttgcttaataatgcaaatgggagattatagaaaaaatgatcaaatcaaatgactatatggccttatagcttacatttaactccaaggcaaaataatctaaactaaacctggaatagaattgaattattaagtcctatgtaaattgaaattttttctttctcttttagataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttgaaatatttctttactagagcccatttgccatatttcatccacctagtaaataaaagagtaggacccccaggcctaagcatcaacaaatgctattaagtcagaactatcagcagtaatagtaggtagtttcataagtcagttgacttatttaatgaatgcttcctccacaagttatcagtcttcaaaaagctatatatttttctagtgaaatattttagatcaaaatgttggtgttctcacagccatttaagctagcaaccattgagtatcattgaattcatagcaataaacattgattaagtgtctaatatatgttaaatattaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaagaaattacagacagatacatcataagaaaaatgctaaaacccaaaaacgaaaagaaaatcttaacagcaatacgagaaaaatgagccatcacttaccaaggaacccaaataaaattagtagttgacttcccctcagaaacaatggcagtggcagtgga

SEQ ID NO: 138478 - DNA, 1012 bp, Homo sapiens
ttccagcctctactcattacccaattctaaatccaattctacatttttaggtatttgttaaagcagcatcttacttcccagtaccagtggtactttgttatggcagacctaggaatctaatacagactttggtactgggaagtaggatgctgcttaaagtgaatggcttaaaacaacagaaagttattccctcacagttgtggaggctacaaaatcaaaatgttggcaaggttgggtccttctagtggctctgagggagaatttgttccatgcctctttcttagcttctggtgtttgctggcagttcttagattatctctctaatctctgcctctgccatcacatggcattctggttgttgactgtatctgtctctgtatcttcacatgtccttcttataaggacatcagtcattggactcagagcctaccctgtgacttcaccttaactaattatatctgcaaagaccctatttccaaataaggtcatattcttaggttctgggtagacatgaattttgggaggattctatttaacccagtacatttacttgttgccgcttgttcacctctcattcactttttttgcaaacgatctctttatagtgagatagatcatgacaaacagcacttaaaacatttttaatcagatcaagaaacagaacatgccgatactccaaaaatccccatatgtccctcacaaatcacaaccctcttcccactagatataactactgccctaacttgtgataatttccttatttttctttatatctttaccacccatacatgcagcactagacagtctggtttggttttgcctgtgcttaagcattgtgtcagtgaattatactgtatgtattctattgggtcttccttttctactcaatattgtggtgttttctggcaattatatttgagatattcgtacatattgctatgtgtagccatagttcattttcattgaagtatagtatagtattcctttatatgaacataccatagtttatcca

SEQ ID NO: 138479 - DNA, 1007 bp, Homo sapiens
tagtacagtctgccctctggtgccaaaaattcacatctatccacgtgcaaaatacataacatccccaaaagtcttaacccattccagcaccaagtctgagtcccaaatatcatctaaataccaactcaaaaagtcctaagtctcattatctaaatcatctatatcaggtataggtgaggttctggatatggtccatcctggggcaaaatttctctccatccagagactggtggagctagaaaacaagttatctgcttccaaaataaaatagtgggacaggcataaggtagacattaccattctgaaagggcaaaaatgagggaataaaggggttactggtctaaagcaagtttgtagcctagcatggcaaattccattagttttcaaggcctatgagtaatattctgggctcagtgctttgtccactgggcccatatactcagtctatcagggcagctatagccccatcctctctggcctctatgtctgtggctttgctcttgtaatcatccttcctttgtcctgtctctgtctctttcacaccaggctggcactggtggtttttgctggtataagattctcaaaaacattgtcagtctcatatatgtcaagagatttacaccattagacatgaggtttctctacagattcttcctagataaccccatctgtattcctggcttctgctgaggtggttgattggatcctaacaccctaacacttaatctcttcaatgaaagtttgtccatctatactgttggccctgtttccagagcacgctatctgtataggctgagaattttcccaatcatcaagtgttgtccccttttttcttaacagttccttcttcaattttcctctgtcctcttttattttattataagcatcagggagaaactagcctgcatcttccacactttgcccattcatctccttagtgaaatatcagtttgtcacttttaagttaaactttttgcccaacagtagaactcaattcagccaagttt

SEQ ID NO: 138480 - DNA, 1102 bp, Homo sapiens
attcacataccatctcttcaaccctgtttatatctccagttccttgaccttttaattttctcccaatctgtcagcccctttctatttcttcttgctttcaaatctcacttagactctatcatccattatttaaccacccatcttgacaatgaatcattctctttgcttccttgtctatgtatcacatccacccagcaaaacctcaaactcaaatcaaccagactaattgccttctctatttctacatcatggcttctgggcactgctagaaagaaaacataactttgttgattattgcctctacaactttctcgtctctgttattggttagagcctctcccttgttcaacaatctatctcctagtccctagtcagctcactatttcattccttataaatagtattttaaatcctcattactctttcctttcctactattttgtcatttttaacagtcttccatcctatttcaaaggaaactgccatcagcaagaactttcatccatttcctgcttcatgctctgctaacttctgtatcctcacccttgttttcttctctcttgactcagtgctagggaagtcctttctgcttaaggctaatgtgtataattttgtgctggatcctatcccttttatcttccaaataacttcagtcatccccagtattccttctttctttttagggttttaacatgacttgtatacttgtcagactccatggtctacatacgcttaccatgaactatctaaagaaaatgataaaaatgaaaaatgtctttcaattgattagctacttgaacaaataatacatttagattttcctctttttttattatactttaagttttagggtacatgtgtacaacgtgcaggtttgttacatatgtatacatgtgccatgttggtgtactgcacccattaactcgtcatttaacattaggtatatctcctaatgctatccctccccactccccccaccccacaacaggccccggtgtatgatgttccccttcctgtgtccatgtattctcattgttcaattcccacctatgagtgagaacatgcagtgtttggttttttgtccttgcaatagtttgctgag

SEQ ID NO: 138481 - DNA, 1694 bp, Homo sapiens
actttcacattgttctgcaactatcacagccatccatctccagaaatttttcatcttcccaaactgaaactctgtacttattagatactaactccccgttttctccatccccaccagcctctggcaaccaccatcctactttctgtttctatgaatttgactactctcagtatataagtggaatcatacaatatttgtccttttgtgactggctttagttagcataatatcttcaagattcatctaagttgtagcatgtgtcagaattttctttttaaggtggaataatatcccattgtatgtatatagcacattttgtttatcaattgatggatgcttaagttgtttccatgttttagcttttgtgaataatgctgctacgaacatgggtatacaaatatctgtttgaatacctgctttcaattattgtaggtatatactcagaaatggaattgctggatcacatcttaattctacatgtaattttttgagaaactgccatatcagtttccatagagactgtaccattttacattcccaccagcaatgcacaagataagagttccagtttctccatacccttggcaacacttactattttcttaaaaaataatagccgtcctaatgggtatgaaatgttatcttattgtggttttgatttcaatttccctgatgattagtgctgttgagcatcttttcacatgctttttggccatttgtatatcttctttggagatgtatctgttcagatctcttgtccatttttaaaataagtttcttgtttgttgttgagttgtagaagttctatatatattctgtatattaattccttataagatatatgacttgcaaatattttctcctattccaagaattgccttttcactctgtcctttgatgcacaaagtgtttaatttcgatgaagtccaatttgttgatttttttcttttgttgtctatgcttttggtgtcatatccaagaaatcattgccaaatccattgttatgaaatgaaggcttttccttatgttatcttctgagagtgttatagctttagctctcatgtttaggtctttgaaccttttgagttaattttcgtatatggtattaaggtaaaaattcagctttattattttcatgttgatattcagttttcccagtgccagttgttgaaaaaagactgttctttccacactgaatgatcctggcaccctattcaaaaatcatttgactatatatacctgtctttatgccagtaccacactgttttaattactgtaaccttgtagtaagttttgaaatcaggaagtgtgagaactccaactttgttctttttcaaaattgttttggatatttggggattggttgagattccatatgaattttagaatggatttttctattcctgtaaaaaaatgttattgacgttttggtaggacttacattgaatctgtatatcactttggttagtattgatgtcttaacagtattgtcttctaagtcatgaacatgggatgtctatttatttgtgtcttgtttaattcctttcagcaacattttgtagttttcagtgtataagtcttttacctcacagaaaatgttttcaagtattgtttcaaatcttgtttatcagttgatcctttcatgggttgccttttatgtatgtgcatttatatgtatctaacaactctacctg

SEQ ID NO: 138482 - DNA, 1870 bp, Homo sapiens
tcgatggagttccattttgttgcagtggtgcttcagcttagaaataagatgtaagagaaaatttgctggtgagtttcattgtacctcttacagtgctgaacctccatttttgtgaatgatagtaacctcaagatgttcttactctcctcctgcatgttttgcagatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaaggtgagtggggtaatgtttttttttgttggtttttctcctcaaagaaacagagcaaaatatcttcattttagcactgagagccttttcatttctagttctcacaaaactgagcttggtgtctgaatcttctttgatttttagaatgcagacattggtaaaagagaagctgttctttaacttcttagctaacactttctgtaaacattcatttctgggcctaggtcatctttttacttgagataccagatcatcatgttcaggttgtgccctctatgatacatgccatctcattcctctggtttcagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaaggtatgtgatccccactgactttgatatattctttcactgagagaaagattaaacagcagggcattaaatatgaagagttagtgaagggaataggggaaagacaaattgtcactacttttgagaaatgtataataccataagagagacaaatatgtgcacagttagttgcatgacaacatggaaactgctattatagagatttgaataaaatgctgaggtagtgcagaacacagagcatctaagtctagttgggggagtcagaagttgacatttatactaactcctgatggatcaatgggcatttgtcaggtaaataaaggggaatggagattaaaggtagtaaatagcaacaggattatgaaagaacctggtgtgtctaaggaacaatgagaagtttaacgtggcaggagtagaagaagtggcagggaatgacaggaggtgacactggaaggaaggggaggcgaagctagattgtgaagggtctttaggctgaactacaaattagcacaaaatatatagataaatagtatgtgtcttaaccagaaggatttagtttgacagataagttttactagacgctgtggaaggtgcatggaagtttaagaaatggttcctcaccttgtgccaagtatagtctggttggagagataaacatgtaacatttagtgacaatactagatacatttgttaagtgttgttggagttcagaggaggcaaaggccactgtgtattggtgtgattgaagaagccctctcagaggaggtaagatttaaatgttcttttaatactacctattctttagaaaagagaggtaatgacatttcagttgcaacagatggtgtgagcactagggagtgtgctaactatggaggagatgtgagacaaggttagaaaggtagctaaaaattttgaactgtatttggtaactagtatagacttatacagagttagttatcagttagtttcaatatggttgaaggtttttgaaccagaagtgacatga

SEQ ID NO: 138483 - DNA, 1054 bp, Homo sapiens
gtttcattgatctctatggctattattgcccatatcatgctgtcttgattacttgattaagttttaaaattagatagtgttaaatcctacagtttgttcttatttttcaagattgtttttttctggatcctttgcctctccatatacatttaaattaagcttgtctatttctataaaaagagcctgctagaattttcatagggattacattgaatctgtagatcaacttgtggagaattgccatcttaacaatagtgagtcttttaatccatgaacatggaatatatctccacttatttagatattctttagtttttcttagcaatgtttttttgttgtcagtgtacaggtcttatacttcatttgttaagtttattcctaagtattataattctttttgatgctattgtgaatgaaattgttttcttattttcatattgtttagaacaattattttttaataatgtcaatatgtgtatgccatatttaatatgctggcaggaaccagtcaatcactgatgcttgtcatgggaccaaaattctgggcattaagtacctaggtgcagtttttgcccttaaagaatgaaagtcctaaaaaatttaaagtatgttaatacagaaatagtcctgggaattcaattagaagacatgacaaaatgctaatagtaaggctttcttaagaatgctgacttgtatttcttgacagtttattgatttttaaaatcattataaatgtacccctttgcatttaatatgtatcaatcagcaaattactagaatgtgcctatgttgacacttctgatctcaagttaatggtttgttgtagtgctcatctgtgcttccatcatattaaaaactgttatttaggtgaaaaaattgcaccccgcagttagttattacaacaaaaaggagatatagtttgccaggttgaacataatgtttttctggccttttatagacagccagcattgaaatcactgtccttaaagcatgatcttgcagaatgtctttataagataaaatgaggtattacactttaaaaactgggtaacat

SEQ ID NO: 138484 - DNA, 1133 bp, Homo sapiens
ctctaacttatgtgatgggttagataagtgatgggactgaactagaaaggtgtcaaagtactagataattgaattaaggagtgtctgaacatgtgtaggtaatgaccagtttttacatttgatatttccctcctttgtttaacattaactatgccttttttcctcccgatcagtctagataattgggaattagtagtaactatagtcaaataccagtttcccctcttgttattctctttgtaaaaatttacaacattattttgaggttgacttgatggcaatgctgcagtcacacatctgtcttctgagttggtagtcattgaaactgcagcaactccagttcttctgggaccacttatgacagaattggcaatgcatctgaaccaattcgttactagttttaagtatatggtgctacttctcttagagaggcaacatggggtgagggataggcattttctgtttcttcatataccaaaccataatcatgtctggtaatatttatccaacaccccaataaaggaacgggcaatggaaaaatcttatacttgtaattatttgaaagttcactgagtattttcatggcattttacttctttcataaagtatcccaaagcttcaagactaaaatatatttcttccacaattattgcagtctcttaaggaatagaactggataattatttaatagctgctcacaacatttaggctgctatttagggcagagttactccttagagtaactataagcaccatagggattttgtaatatttccaaaataaaatcccattagtactaagctgaatggctatgaacaccttatttttttggtgcaaaacattcttagttgtctctcatgatttgactaactcttgcataaaatgtcataggatcattttagagaagtagttttgtgtgatatgtaataatcatactttatatttacccagtgttaatatttattgtctgagggtattgcttttaattagattttttggagtaggatttttttaagaagctttggtgcagacaagaaagattttttaaaaatacatatattatatgtattttttgagacagagcctcactctgtcacccaggctggagtgcagtggcatgatctcggctcact

SEQ ID NO: 138485 - DNA, 1018 bp, Homo sapiens
ggtatgaactcagactattgatttgagatttttcctattttttaacgtacacatttagtgctataaatacccaactcaacacttccttaactgtgacctacatattatgttatattgtgatttcattcagctctatatacttcttaaatttcctttgtgaatccttctttgactaatttattatttagaagtgtgttgtttaatttccaagtgtttggagattttcttgttgttttttctgtattgatcgctactttgatcccattgtggtattagaatatgctttgtacgattttagttcttttaaatttatttaggtttgttttgtgggtgaggatacagtctgtcttgatgaatgttccatggacatttgaaaattgtgttttctgctgcagggtggaatgttctatatatgttaattaaattctgttgcttcactgtaatttcagatactgtgttattggagtctttctgtctagtagttctttcagttgtggagagtggctttttgaaatctccgcctttaattgtggatttctctatttctccctttagctctatcagtttttatttcatgtattttgaggctttcttgtttggtcacctatacatttaggattgctagccttctggatgccttgattcctttatcactctgtaatgtctctctttggttctagtaattttctttgttctgtagtccactttatctgatattaatatagccatttctttttaaaaaaatgaaccttgcatggtacattctttccattcttttactttcaaactatgtattaatatatccttgtatttgaagtgaatttcttatagacggtatattgttggatcattttttattcactcttccactctctgtattttaattggtatgtttagcacatttatatttaaggtaactattcacatgttagagcttaaatctgccattttatttgtttgttgcctctgatttttgttcttctctttcttttttttaccctgctgtcagttgtttgag

SEQ ID NO: 138486 - DNA, 1038 bp, Homo sapiens
ttctaaccatagtgactcctgggcttctttgtgattgggcatggtcttcctctgtggtgcacattttaccctcacaagggctaacataaagaatggggaattatcataagaacctttgtggccaaaaaggaaatggagtcttgtggaattcaagtaaagtcattgccacgacactgttaccttaaggaaattggaacttaagattattcttaaggcagctttagggacctcccaaatcaaacattgcatatacataattcggttattctccctttgtctacttttttctttttttaaatttctcattggtttccttacctctttctctgccttcctgctgtaccttattcttaattgtgacttgctcatggtcccttacttctacttcatctccttcttctgtcagtcctatcaagtctttttgcctatagttggattccttctatacttttggaaatatttcccagtatctgcctagagtcagatttttccgtattgctaaatttttgaaaatgaaattctgactcatattaatcctgtttcactagagctttttgtgccagaccctcaggtaggctgctagtagtacattggatggcttcccatccttcagttggccatcctgcccagtcaactttgaaccaggaacaaaaaggacagagttatctggaacaaagaatgggtatttgagcttgttccctcagcaggaatgttccctcaggccagcctccctcagagtagtcagtgcttgcagcaggcaccatggtttatgcatttatccagtgtggccattaacctgaaactattgctaattgggaaagcaaagctaacataaaacaaacaatcatgtacgttatattttcataacatatttcttgttacagaagcagcatttactagttgtaagaacatttgaaaatgcagagaaccaaaaagaagaaaataaaaccttcccaatgccctagcagccacaattttctgtgccttgttcattaagtgctcagtgtgtagtaagaaccaaaagtgctgcagaaattt

SEQ ID NO: 138487 - DNA, 1025 bp, Homo sapiens
cccatggacatctttgatatgtttttttggaggaggaggaaggatgcacagagaaaggagaggtaaaaatgttgtacatcagctctcagtaaccctagaagacttatataatagtgcaacaagaaaactggctctgcaaaagaatgcaatttgtgacaaatgtgaagatagaggaggtaagaaaggaggagtagagtactgtcccaattgccgaggtactggaatgcaaataagaattcatcagataggacctggaaaggttcagcaaattcagtctgtgtgcgtggagtgccagggccatggggagcagatcagtcctaaagatagatgtgaaagctgcaatggaaggaagatacttcgagagaagaagattctagaatttcatattgacaaaggcatgaaatatggccagaagataacattccatggtgaaggataccaagaaccaggactggagggagaagatattatcattgtgttagatcagaaggacgatgctgtttttactcgacaaggagaagaccttttcatgtgtatggacatacagctggttgaagcattccagaagccaatatctactcttgacaactgaaccatagtcatcacctctcatccaggtcagattgtcaagcatggagatatcaagtgtgtaataaatgaaggaatgccaatttatcctaggccatatgaaaagggtcgcctaatcattgaattcaaggtaaacttgcctgagaatgactttctctctcctgataaactgtctttgctggaaaaactcctacccaagaggaaggaagtggaagaaactgatgagatggatcaagtagaactggtggactttgatccaaatcaggaaagatggcaccattacaatggagaagcatatgaggatgatgaacatcatcccagaggtggtgttcggtgtcagacctcttaatgggccagtgaataacacccactggtggcattttatgtgcagtagtaaatgagtgaaggactgtgatcataacatgctcactacttgc

SEQ ID NO: 138488 - DNA, 1049 bp, Homo sapiens
gggatgtgtttttgttttctgcggttcctttttcctctgccccaaccttagcctgagctgctattttctcaacagcatccaaagggggaagcaatcattggtttgagaagaatctctgagccaatgaaatgtcagctcagctattatttccaggtgcctaaaggagaattatccatagatggagcaaaacctctgttgaccagaatatttgaggatgggcagataattacacagctttccggtgaatcagggttataattttgattcattgttgaagttctctctaaagtatgaaacctctttcttgtcttagaatgtaaggcccagtgaaatggattctgtgtttgatgactaaggaccttgctttctaaatatcagccataatatttagtcttatagaaagttgtatggtgtagcagttagaacaccgaattctaggagtcagaggatgtgggttccactttgagtgcagccgcatattaacaggtgattttgggcagtggtttatcatttctgagcctcaatttcctcacctgtaaaatgaagtggtgttatttttattttattttgttttatttttgagacagagccttgctttgtcgccaggctggagtgcagtggcacaatctcggctcactgtaacctccgcctcctgggttcaagcgattctcctgcctcagcctcccgagtagctgggattacaggtgcctgccaccaggcctggctaattttttgcatttttagtagagacgggttttcaccatgttggccaggatggtctcaatctcttgacctcaggtgatctgcccacctcggcctcccaaagtgctgggattacaggcgtgagccaccacgcccagcctgaagtggtgttatttttataagatggagaaagtatatgtaaaaatgtggactgaactcagaccatctcttggaaattacttacttgaattatctccttatgcaggcttacttcattattctttgcctctttctccaaacagctgagtgaaggaaaaaaggtatatgatcaatcaatagatcgaata

SEQ ID NO: 138489 - DNA, 2129 bp, Homo sapiens
tcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctggtaaggaccaagttgggaccctgactagacctcacctgcccaggcggcagagtataggagggatggggtcgccgcttgagctcaaacagactgggggttggggggagagggtgcagctctgtgactagcctaccccacgggctgtttccgttattttacctctcgcgggagggtcacgttcattcttaccgtgcggtggggtggagtcaaaagatggagtgtgaggcgaagcttctgcgtttgagggcaagggctgggggacccaatagatagtggctgcatagagcgacgagaggggaccgacgcttagccagggcggtagggacacgtggcttggctttgctgttgagccacccaggctggactgggttgcttcagctcttagactagcttgcatttagagagcctacctgcgtactgagctctcctggtctttcttttcctagagtccaataagcagctttttgattcgaaatggtgttggtccgttcggcttggtgttgagggaaactgacattatatactgcaggcgccaaaattattacgacttcccttagatcagcaagcgttggcttttctcatcttatgaatcatctacctgagtaattggagccataaatctagttgatttgttaaagtgatgcgttgactctgcatccttgatagccagcatctcagcttgagccatccaaaaaatcttggaaatctcaattctggaatgtttgaccttccccagtgcagctagtggtacagataatgcaaaagcgtatttttcagtaaccgagtccatcctggacttggctccttctttaagctctgtgtagggaatttaggaaacaattttatacctgaatgttaaagataattgaggacaggcaatgtagtggaagactaggattggacagtgcattgcaacttgcgttttttccattgccttgccagtaaaacttgcttcctcgactccgacttacaccctctaccggcaccatgggactgttttagagatgacttggttacctgattatttcagtgccccttccacctaagtgtgggatctttagtttctgataggtgtaatttgtattttattgttaccctatcgattaaatcagagccctgcccacaatcttacagatttgttaaggggaaagttttcacctaataatcagataagaatatttcgaatattttttcctaaatgtttttgcttacttttttgctttctttggactgatttccaagtttaactcgccttatctcttttagacccagctgataaagtaatgtcaccgataatggacagcttcttcccgaattattgtgctactgattgtgatgcaaatgatagtgtaaacattgccatctgtaaccaggcaataccttagttaaaagaggcttacaaactgctgtctttagatttttccaaaccattatggctcatgggccttaataaagaatacaaaacaggactagactttgtgattggcaatatagttaggggacaagaatgtttttcatttagaggttttctttggcccctgtggatatttaatccttttcctatgcgtctaggaaaaatgtgaaggcatgaaagctttattttctccttgtgttaatccttctgccctctgcataatgcagcaccccagaacctgaggctatattgggagaggagagggggaggacaacttagttttctactgattgatttctattaagtccaacatggataattgctgactggttagattttcttgtttctggcttaatcattagcttcttgtttcctagatattctgaaatcttcattgaacataatcacatttttttt

SEQ ID NO: 138490 - DNA, 1121 bp, Homo sapiens
gtgtcacaaagtgaagtttttctatccaagtggcagtttttaagtatttttgaatggatgtaagtagctagcacatgggttgaatatagttttaccctttcctcttttactgtcctcagttactactcggaagacaagacagaaaaggggtcctaaatcatcatattatggatttgactataacttatgagtaacttggtgctacagagctagcaatacagctataaaccttttgggaagggtagaaaatgtggttttctaatgaatagcagctgctattgaaccacatattggtggacaaattcgcttttacactcctcttacaatgctgttggttagatcattttgatccttgggattaaaatattaagcaggaaggaaagtaaagtgtgacatttttatttaaagccaagatcttaacattttaaacaaactgattgccagggattgccagttaacagtgctttgcagctcacatggtgcagactaagagctcttgatttccttagtggattactcgttagtaatgcattcaaaagtgtgacacatgttcttcttgttgtggaaatagaatgaagagctacaaaacacagatgattaggaagagctaattcagaactttctaaaagccattcaaatcttcaatgactgtttctcaacaacctcttttatttcagtaacttcaacagaactgataagctgagaacttgagttatgttatccagccagatatatgggttggtgagtcccatgtaattgctagttaccatctgtaatgctagagacagcctaagaaacatccccccaactagtagttgtcatatttaatttgtcggtcattattttaatatctttctgtgggacttagaaaatagtcacatttgaaataggcaggattttctttccaaaggtgggtataggaaaactgcctttagtagacaacttattgctacctgatttttttttcattatcattgtcttatagtgatggagtattttacaattgagtgtctatcacttctgtgttggcagggtttggggagtaggtagagatccctgtgtgatattcatttgtacagtagttctctcctcaaaaggtgtagagagttactttttctagc

SEQ ID NO: 138491 - DNA, 1217 bp, Homo sapiens
tgtgaccatagtcacaagagaaacaggacaaaatgctatagtttgttcagttctacattaaaaaacaggacaaatccccaagcacgggctgcttcacacatgacggagatggcacagcggagcatggacagacgtgccactggggcagctcactgtcatttacactgaatagatttttgtttgaattatgtggtactttgtcaaaagacaaatttgtcttctatcctaccttctagtctggtttattttctcttgtaataagaaaaataagaattctctttgattggaagatactttggaccgaatggtgagatgcctagcttgtctgggtaattgatataactttctgtctagcaattgtgaaaaaaactcccaagcttggtgtccaggtacagttgacagtgacagttgatggatgttttgccaacagcactgagggaagtgatgaggacacaggcattggaacaggctggatgctgctcctctcctgccagtcaggttctcttctcaccacatccccattcacgggtcttccatgatgggaattgggacagtctgtgtactcctggcattagttaattctttcctcattccttctgctgccaatccattaaataaacttgcgtgtcttagcgttatactgcttcccagtactggtgagggtgtctgtcctctacccagaatgaatactcatctaagtttgatcagtacgttcataagcttctgttgagctatggaggcactggtttataaaacccagtttgtgatatttgcctttgagaagtcaatgatagttgctttcattcttccagccctgggaactattggtttcaaggagtattctcctccccaaaacaagcccattctttagtccatttctttttttcttttttttttgttttgagacagagtctcgctctgtcacccaggctggagtgcagtggcgcgatctcagctcactgcaagctccagctcctgggttcacgccattttcctgcctcagcctcccgagtagctgggactacaggcgcccgccaccatgcccagctaattttttgtatttttagtaaagatggggtttcactgtgttagccaggatggtctctatctcctgaccttgtgatccgcccacctcagcctcccaaagtgctgggattacaggcgtgagccaccgcccccggcctctttagtccatttcttttgtcttagaagccaca

SEQ ID NO: 138492 - DNA, 2108 bp, Homo sapiens
ttttgatgaaccaaagtcagcgttttttctcagttagcattttgactctttcctaagtggctgttttgttttgttttgttgttttgagacagagtctcgctctgtcacccaggctggagtgcagtggcacgatcttggctcaccgcaacctccacctcccaggttcaagcaattctcatgcctcagcctcccgagtagctgggattacaggcgtgtgccacaccatgcttggttaatttttgtatttttagtagagacggggtttcatcatgttggccagcctggtctccaactcctggcctcaagtgatctgcccaccttggcctcccaaagtgcagggattaacaggtgtgagccaccgtgcccagccgtaagtggctatcttaaaaatgttatgaagaatagctgagtgcagcctcatgacagggaaacagcacagtgttgcagttttaagaggaagggcacttgcctggctgctcatcagtgtctgcaaattggccagtcatctctgaccatatgatagtaacctgatttcctttcttgcctttctaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgatttggggtctgtatcatacataatctgtactgatctctctgctaaaggtttggtttagatagatgtcttgctgtccattgatagctcttatttgtttccaaactacgttagcttcattgttaaaccaagagaagacattggcagcagttttattcaactgtaagactaagatgtctggagtttactgagaatgtgataagagtgtaattctgtgcagtatacctaaattatagcatgtataatgtctggtggatctctggttcttactcctgaagatccaaattaggtattttcttatgggaggagaatttctgtgatttattcattttgaactaattttgccaaatgtgataatttccttccattcatcagtaattgacatacgtttggcatttactttctttgttttttttgattttttggtttttttttgagatggagtttcgctcttgttgcccaggctggagtg

SEQ ID NO: 138493 - DNA, 1154 bp, Homo sapiens
agcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtagga

SEQ ID NO: 138494 - DNA, 1135 bp, Homo sapiens
aatgttcaaaaccagagtgctagcaaaagtatggcatgtccttaattttaattgcctattcattttgatcactggattttccaactgcctacccctatggtgacatctgtataaatcagatgtgattattataattctctttgagagtgatgtcttcacatttccatgcccacagcctgccaaaaatatagctgatgaaaaccagggggaatagaggaatttcctgaaaggaataaacaagcacattttctttttctcattacatttccacaaattcattactacaaataattcttaaatgcagttacatttacatatcagggatcttgttataaaatattacccagcactggagtaagccttttatcatgggaaagtaacacacacacacacacacacacacacacacacactctctctctctctctctctctctctctctctcagcaagactgggacagagaaagctaatgattgccagacaatgagaagggagatatgagacttggaggatgttcaaaggaacgccacaatgagagttaaaaggttggaaaatatagtgctctagaatcttatcacagttgattacttgtccttcttcctattcagtcactctgtcatccacccacccattctcactcagtcaccaccttctcccagtcatttatctactcacccacttgacacccactactgtctgccaagacagataccctctcaactaatgtactaatgggcatatgactttctcaaccagtgtaagtataaatataagggaaagaaagtgaagtatatttatgagagactaggttgagagtatatttgcatacacatgtatgcatcactgtatatgagtgtgtatattcctgcataaatatgtggctgagaatgactctgtgtctgtgtatgaaagtatatctataaaatgtgtatcattgtatgtgaagatgtgagagtgtgtaaatcttctgataatttgggtaggagggggccatgagtgtaaggtaagctttctgttgtcaccctagggagtgttagagcctcagcagaacccatcctgaggctaaggatcaatctaataaatgagccagatcaaacatatgcatgataagaaaaatcttcaatggaggccagg

SEQ ID NO: 138495 - DNA, 1073 bp, Homo sapiens
tcccagcttctcaggaggctgatgcaggagaatcacttgaacccagaaggcagaggttgcagtgagccgagattgcgccactgcagtccagcctgggcaacaagagcaaaaatctgtctatatatatatatactcattttgaaatttaaaaaaataagttgaagaccgtatgttaagaaaaccatataatcactttaatgtctacataagtgtttatgcaggcagactagacagctggggcagtcatcacaaaaatttaggcttatatctttgctaaaatatttttattgatgtagcaaaagtggttttagggagcttgagatcccagcattttgcttcaggttgcatggttcatgcaatctaaagattctctattaagaaaatctcttcaagagatgttgggttacgcaggaagagtaacaattgtaaaattccagaagagaaagtatgctttccttactttcttttccacctttccttacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcaagtgtttgtaagacatgttaggttgtttagtatagtgtttcatagacagtgtaagctccccagggcattgcaaagaccttactgatgggtaacaagcaagttgtatatttccttgctgggcagttgctggggccattcccattcatttatgtaacccttagcctttcctcaattaatccatgtcactccactttcccaaggagagtacagcttggtacttgttccttgccaccatcattgctggttctgtgtgtatgaacatctctctccttgactcttcttctacttcattatcgtggtaaaatacattatgttcaaagacttttcctttaccaaacctacctctatcagt

SEQ ID NO: 138496 - DNA, 1780 bp, Homo sapiens
gttaggaaaccatgaatgtgtatatgtaatatataaagtgaacatatatgtactttatatatattcacttgtgtatgtatgtttatgcatattcactttatatattacatatacacaaaaaacttttttttccaaacaccacctcgaactagaacaaaaaactttttaatttgctaatttgagtgagaaatatactggaagggaaaataagttacaccatccatttttgtcccctaaaggaaacatcaaaatcaatcaacatttatttcctccctctatccatcattgccttcctccctcctgtcacgcacacatacacatgcaaccatgacacagataatgggaagagctttattggattagcagagatttacagacaagattgcacaagagatgctgttgctggatagaaaattgatcaggtagaagtgatgctacctacttgaggatggccatctgaattgttaaaaattctgtcatagactattaaaaaaaaagttttactactcccaagtacacacagttatgagaattaggcttttaaaaagttgcacagtgaaggctctttaggaacctactttacttaatcagtaaaaattgagtattattgatgcaccaactattcccatataaatgtacttgctttttcagataaaacacttctgaagtgctcaagaatgtctgaaaacagtttgttttcttaaataggataaataatcattccttttgcaatcttgtttacagtattcattctcttagccaatccctccacgcaaatggagacaaacttcatcccagtcctaaccagtatagttgaagggaatggagccttgtagtctatgatttttttttttaaatttccatcgaagggattggggatgtcagagagccagagctttcccctttccaggagctaagttggcttcggaagtcttctgggatttgtgaaaatattactgttgtaaaattacaaagtggtagccataacaactccctcagattggagacttgaaatgtcaaaactcccctcttcctttcccctagtttggtggatgctcatttattaattcattcaataaactattagatgccaggtaccaaactactgccatgggagtgcacatattaacaaaatgctctacctgctgccaaatggcttactattctgtggaagaaacaaagtatataatcctccccaataacagttatgtattgtttgttcacttaatgtggaaggcaagactgatgcagacacacaaggaaggctcaaaaatataaatctagcagcaatgtcatcttttttgattttaaataccatatgtgcttactgctaatcaggaaatgaacaacctcagtaaaattcatcagtgctggtaaatagtttgctgtagtggaaagctcataacctttggattcaaatgatcctagtttctgtaccatttattagcgttgtgacctaggacaagtacctcacttctctgagcctgtttcctcctctgtaaaataatgtctacttcacaaggctgtttcaaaggttaaaaaagatagcatatgtaaactgtcttagctcagcgcttgacatttcctaagtgtgccataaatattaatctctttccttactcccagctccaatacagcgtaacagtgctttaaaatgtatgtccttcatttctccttcatttctcagtcacctttgtctcttccctagggcatatccccaaattcttaaacaaaaaaaaatgatttttttccccttcatcaaacttttcactggctccct

SEQ ID NO: 138497 - DNA, 1038 bp, Homo sapiens
agaggagcctttttcttgcacttgttgttccctctgcttgaagtgtccttctccacatccccacttcaattttcttttcctgactaacatcttctgttattcaagggccatctcctttgacaagccttcaccaatttcttcttgtgcttccacaaaccctggatagtgcttactctgctgtatcgtcatttcatgtcaactcatctttgttttccactagactgggtgggaagcctgagacataagagaatgcaagaagtatttctttagaaaacgaataaatggaatgaatatatgtttacaaagccactttcatttatgtaaacatgcaccgcttctgtatccacccatccatttattcagtaaatatttattgagcacctattatgtgccaggccctgttctaggtgattaggatgcaggaatgaacataccagataaagtccctgtcctcacagagctcatattttagtgcagaaagacactaaacacagtatgtactgtaatgtaacatgatgataaatgctctatggagaaaataaaagtagggcaaggagttttagggtgacaggtgcatagggcaactggggaagggatcgctgagaaggtgatacttgaacaaatatttgagggaagagagggagcaaaaccctacagacaactggagaagagcataccaaatggaaggaacagcaaatgcaaaggccctgaagtgggagcatttttagcatgtttgaggaataaaaaggaggtcagagtggctgcagaaggctgagcaaagagtggtgggagataaggtcatagaggcaatggagatctagaccatatgccatcaacttatccaaccacccattgaacacataccctcactgaataatgtggtaagaaatttcaatattgctggggtgagtggtggcagttccagggagctatatgtaggacaaaacagctttccctacagatagatgctttccttagttctctccttacccagagcccttcccaccaggttctcagatgcaggtcctacaggagacc

SEQ ID NO: 138498 - DNA, 1072 bp, Homo sapiens
actctgatgatatgaatgtttaatgtatcattaaagtcccgtgtgtccctgaagctctgtttacctttttcaatttattttctctctattgttcaatcgcataatttctattgttctgtcactagtttcactgattcttttttcagtctcctttttgctattcagcccattcagtgagtatttcattttggtgattgtgttttacagttctaaagcttccatttgcttctcctttatgtcttttatttctttgctgagactttctttttataaaaaaatttgttttcagcatgttcgtaattgcttgttgaaacatttttaagatgactgatttaaaatccttgtgggattaattccaatctgtgtcatatcaatgttggtgtctgttgaatgtcttttctcattcaagttgagatgtacctggttctttttatcatgagtgattttctactgtatcttgggcattttatgagactctggattttattttaatcttctgtttagtaggcctactctgacaccattctggtgggggaatgggagcacagttttattattcagggaaaggtgggagtcaaggttcctcactcaccatccattgatacccagggtaggggtagggatgccattattactaggaaggagtggaatttcaggatcctcactaggcctccagtgacaccactgacacctccctaggcctccattgacaggcctctacaaccatcatatgccgggggactcattactgcctggcaaggatgaaagtcccagatctccattcggtcatttctgaaaccacctcagggagaaggggatgtgtgactatttaaaaccagttgaaggtagaaatctaggctccctacttgatttttgctgagggcagtggagggaggagtatagttttttctgctgtggtgtttgccttggatagggaagttattacctaaaagttttctgtctctctaggctaccccttttctgttcctttggctagagatagccagttttttgaggcacttttttttttttttttttttgcacccatggcattgctgggttgctggcttct

SEQ ID NO: 138499 - DNA, 1022 bp, Homo sapiens
ttctgatgcctcatctagggatctttcccctattttacaatgtccttcttgctgttcagatcttcatagtgtatattcagaatagtcatgagccttccaaatctctttgaccattttgatgattgcctttggtagtatttgttctttatctaagtaagactggcttccctgagaatttcagggccatgcaagtgagctatgcaaggcaaggtttgggtctggcagatgatgacatggaatggactaagggttggtattcatacatggcagtcacctaccaaaattgcatgtatacctagaagtcttcaagcagaaaacataagggacacatttagttcatttgcttgttttatgtttggccatagaacctgttttggttgactcagcactatgtttgcaagttccaaccatatacccaaatcttgtttgatctgtgggtgtatctgtcacctcacttttcagagtatatatatttacctgtcttgtgtgagtcccaaatatgctgatgtttcaggaaagggcaatttgaggaacccatattaattcccttccattttgccaacaggtggaacgggcccttcatcagatgctggttggggatgtatgctacgctgtggacagatgatgctggctcaagcccttatctgtagacacttgggaaggggtgagttaaatttgttttataaactttctcagagacctctgcagtatcacttgctgctgttgatttagcttgatgctgagccttgggaacactcagtaacaaacttgagggtcttaaaatgctctctgcaagctcaagtggtggggctgacaagtcaacaaagcccctcataagaaggaaacagctaatgtttccttgtgagtcaccaagccagggagttattttcctgggacagaactgaacatcgagggaggtatgtcatttatcctttccatctttgctattgtttgagtaagtccttagaaatgcaagataacaaagggagcaggaagaagggtgtggtgattaagtctgtttc

SEQ ID NO: 138500 - DNA, 1638 bp, Homo sapiens
ccactgaaaccatgccaatatgtagcaatagtctcttggggcagatttaatttcactaactgacatttctttggagccagtgcttcaggaacatgtcacccctaaagtgagctggacccatgcgtctggcacaggcactatgcctcatgatggagaataggcagtgagtgctggccttcatcagatactccccgcaaagtccttccttcctggctaaacagtatctagaattgaagatggctgagtcttcagatggttcaagtagaggatgcatgtattttctaggcccctgttttcacctggaaaccagcagaccactgtctcagggtttggggtcaaagattgccaattagaaatgttgtgactctgaagtatttaaaactgttttgtcatctccccaggaaattctaaaggagaatttaaggatgtttgaattagttcagaaacatccatcacactggcctccctttgtacctccagccaagccagaagtgacaaccactggggcaggtaagctgttgttcaatggctctcagctagcagacccacatatagcagttgttttatgagaaagaagaattgtggcccatgctttctgtggacagtaaaatttctactcagctggagtgataaaaaaatggcacttctggttattttaatcttctgatgagctgatatttaccaatttcaaagaatgataatagaagaaaatgagctcattgcaaaagttctatgcaaaatcaagatgactaggattgctttttcatggtctggttcagaatagcaaattgaggccatcgataattcaaaggtatcttgaagggctttcagagccttggccacatcaccgtcgttaggtttatgtaacaagtctggctattttgagtctttatagataatttctaatacttggcagtagttctaattgtaagtctcctccacacaagtctttctttagtacagcaattaaaaatgcttagtcttaactactgagtaaagtatttactgaccacttcaacccaagtgtcaagcttttcttctttctcatttccgtattctgatagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagtt

SEQ ID NO: 138501 - DNA, 1016 bp, Homo sapiens
ggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtattt

SEQ ID NO: 138502 - DNA, 1033 bp, Homo sapiens
taacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatctttttt

SEQ ID NO: 138503 - DNA, 1040 bp, Homo sapiens
ctggcaactttggggaggaaggcaatccccagggcaaagaagatcaggaaggaagcggaggtgactacatgcctatgaacaattggggctcaggaaatggccggggctcaggaggtggccagggctcaaatggccaaggctccagtagccatagctcgggaggaaaccagtgttcaggcgagggacagggatcccgaggtggtcagggctcaaatggccagggctcaggaggaaaccagtgctctagagatggccagggcaccgcaggtgggcacggttcaggtggtggccagagacctggaggtgggcatggctcaggtggtggccagggacctggagatggccatggctcaggtggtggcaagaactctggggggggcaaaggctcaggaagtgggaaaggatccgatggtgatggtgaacgtggaaaatctctgaagaaaagatcctattttggcaaattaactcaaagcaagcaacagcaaatgccaccacctccaccacctcctcctccacccccaccagctggaggaactggtggaaaagggaagtctgggggaagattcagactttatttttgtgttgacagaggagccacgaaagaatgcaaagaagccaaagaagtgaaagatgcagagatcccagaaggtgcagctcgaggtccccacagagccagagcttttgatgaagatgaggatgacccatacgtgccaatgaggccaggggtggccacccctcttgtaagctccagtgattatatgccaatggctcctcaaaatgtctctgcttcaaaaaagcgccactctcgatccccttttgaagattcaagagggtacatgatgatgtttcccagagtgagcccaccacctgctccgagtcctccaaaagcacctgatactaataaagaggatgactcaaaggacaatgacagtgagagtgactacatgtttatggctcctggagccggtgcaattccaaaaaaccccagaaatcctcagggtggctcttcctccaaaagttggagctcctacttctctcta

SEQ ID NO: 138504 - DNA, 1050 bp, Homo sapiens
actactttcgtgtgtgtgtgtgtgtgtgtgtgtgtgtgtttcccattcatcaactttggagtttggctctaacacctcacttgaaaacagaaaacaatttcctagcttattcagtggcagtttttgccgctctctctccttttctaaggttcaggtggtgtcattttcattgccgtgaatgtttgtaaaatattgaaagtctaaagtgcttagttgccaagaaaagattataaatttatatgtggagactgaaaaagactcagattcattgagaagattatgtcctaaagacatgcacttaaaattagtgaaaaattttaaaattgcaaacttcagagtccggcctttaaaatgtctgaatttatatgaaagaatgtggactgtatatagagctacatagtggttgaaataaatcatcagcttctgtcagtggttttgtgtttgtgaggggttgaaaaggttggtaatctatacttctggaatttttcttgtaggattttaaaacttatgtagatcaggcatgtagagctgctgaggagtttgtcaatatttactatgagacaatggataaaagaagacgggtgagtgttatagactctactactctttatagactactactctttattaaataccaggttgtgtctggagccagcgtttcatctgacttgcataagtggtaactgtggatttactctttaaaagcaaattgctcagggaaggattggtatggcattagtgggaacatgggctctggaatcatatcccaggtttacttttacctagttctttgacctggagcaagttgccattttcccttaacctcattttattttcaggttggtaagtatgaattaattaaaataccgcacttaacattaggcccagcatattttcttaaatatgtttccttttcttagttccatcaattaaccaatatggttaaggtattattagtgctaatgaaggggtgggtcattacggggaatatttcctgattcgccccttttatttcatatatttatagataatttctgatcatggctcaaa

SEQ ID NO: 138505 - DNA, 2377 bp, Homo sapiens
acaatgtattttaagcctgaaaatctgcttatttagagatagaaaatgatgtgttctcttttttttttaatgtggatgaagagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagattttctcaagattgttttaaggtcttttgatttttgttcttaggtttcagaatggttacttgtttctttacaatataaggttttttaaatttagaaaaaaattacagtagtgt

SEQ ID NO: 138506 - DNA, 1138 bp, Homo sapiens
cataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaagccaatttgtacttcattatgcattgagataaaatctccaagtttgaagattattaaccaaacttttaaacacatatttttaaagtactcatctccaggtttatggaattgcattaagcagttaaaccggcttgtatagtcccatccattagttcagagtatttgaatcccaaactgttactttggtccagtcaatagagtaaaacccctttgtaacactgatactttgggacaaaacatggattatcagtgggcgctaccaaattataactgctacttttaggctaattaatattttagagagaaattaatttgagttatatgagggtgtgtataaaatggcattaagagctctatttcctggctttgccactgtagttgtgtaaccttcag

SEQ ID NO: 138507 - DNA, 2502 bp, Homo sapiens
tctccggggtggtggtatttgagcagacatatggataaagtatggaagtgacacacaactttattgagaaagaccatctcaggcaaatataaagtctctgaagaggaagatgtgtgtgtatgtgtgtgtgtgtgagtataaataatgtgtatatgtatgtatattttaataaccacatagactaaaactatccaactgaaacaacttaggtatactttgagaaatataaaatgaaattgtaaggtagaggtagcattaataaactatctagtataccattaaataagtttgtggtgattggtgattcaacacccgaatcatctaggtaaatcctgaaaaactcatattttattaattgcttctccttccccttctttccccgtccccactcctttctcgtctctttccccccctctccttttctcccatctttcacttctaatttcagtgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaa

SEQ ID NO: 138508 - DNA, 1006 bp, Homo sapiens
atacatctttcatagcaggcctcttcatattttaagtataattgtgaggtatacatagtatcataagaatgcaaaatacttgtttttgggtgatttgagcaactactaatggctatgaaaattgctatttgctgccacctgcaagtcacatttcataatgttctagttaattcagataaaaatgccacatttttgtttgttttgtttgtttttccttctcctaacctttctcacttgttggcaatttattctatttacaggaatctgtgatagtccattgcttcctatggcttggagtattagataatgtttaggagttttcaagatgaaacttctatagcagtctttatttttttggctttaaagtaggaatttaactaagattgttttcagcctgctttcatttgcttgtgtgcaactgaaataatgtgtttgccttgtcccaattttgtcagtgtttctggactaggacctatgtatgtaagaaaagtaaaatgaaataaaaaattggggggccaaatctgtagctgagaatttaactgtttccttgagttccaaatgtgacgttgggagcagataagcttattttatgaaactctgtgtaactgagctgtactttaataacagagtagacctggttaattcaagcaagttttatgttcctttacgacccattcaggcattatttttaggaagttggttgtaatttatatttaaaagattatttttcatactcaactttatatttttctgtcattttagtgagaaactcactagttcaatcaagctttcataaaacgtagactagtactagaaaagaactttggtgaatgtgagttctttgtgcttgccactgaaaccaaatcatttctaaactcgtctaggctattttgtagtagtttttaaaaatgtgcgaatgtttgcttcttggcaattgctgttttaaataatcacataaaataacattttatgttgattaacataacatctgttgattaatattact

SEQ ID NO: 138509 - DNA, 1029 bp, Homo sapiens
tatgaggtaggcatcattatcctgataaaacttgaggattagaaggttaactgacatgccgaggatcacttagctagtaccaggcagagttaccattcagatagaatgttccaaagtcctagttccctctattaaattgattataatatttaagattataataagatgctaaagctttgggtttaaggtgtaacttttagccaatacttacttaagtaggcattttatttttaactggtgtgtatgggcaacattatatatatgcagtttttgccattttaaaagtaatggcaaaaaccacaattacttttgcaccaacctaataataattttagaagaagtagttttgtaaataacgattaaggcaatgatattcaaagaagacagtcagaattgcatataccttagttaaacagacttaacattctttatgacttaacagatcgtaagaaagatctagtgaagttacaagcaggagagtatgtatctcttgggaaagtagaagctgcactgaagaattgtccacttattgacaacatctgtgcttttgccaaaaggtaactttccaaagttgtattttttgtttcgtaagtcaaaagatatttagaaaataatgtgattacatattatcataagggtaacatagtcttctcttagaattttcatcagatctggggaattgtacatttatgtaagttagtgaattcaacagcttaaagatcattttagataactcagacgtgttaactatttattggacacctgcatcttgctaaatacttagctatgcaacaagttatttcatttaacatccatgacaactgagacttagtataagtaattttcccaaaaatgtaacacaactactacatgttgagatgaattttgaacccaagtttttctaaatcaaaagcctaagagattgagccattttctttatatgttgatatgtcttatttttatgggttttattcttttttaaaaattgtaattgtggtaaaaagcatataacgtaagatttaccatctt

SEQ ID NO: 138510 - DNA, 1049 bp, Homo sapiens
ggttaaaacctccttagaaaaaatttgaaatgcattgatatcagtatgtcagtaatttacttataacagcttcaagtgttactcttcctgggggtgattttatcttaacagaactctgtgaacactaagctctaatggtgttctaagtgtgaaatgttatggtatgggaaggtttgagatgggtgattgttggtggtgattatcattgagcctttcttggtgttcttaaaatcacagtcacccagtatcctcatgtaaattttagtaaatataaactaatgttctctcataaagtgatataaaatctgatcagcagaaaaatactaacatacgtataagctttaagaattaatgaaatttgttgtagaacaataactaatttacttttatgatttccaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattataggtcagaatgttttctttttatggttttctttagtttttataacttcagtatatatgaaaggtaatattgatcagtcattaataaagttgatggttccattagttcaaactttggacaagttatttaacttatgtatgagcttctccatcagcaaaacaaggacaataccaacctcatagggctgtcgttaagattaaatgagttgatatatgtaaaatattctaaacagagcctgaaccttagcgtaagtactagcagcactagcaacagcagcattgagtgtagagagaatgggcagggaaatagcaaacaggtaatgagaaaacaaaaagagctcagaggacgtctttcttggtcaaccacatgtgattttatataactgtttcctataacatactctatgctaggccttcctcactcttcacctctccacccaaggggcagcatgggcacatata

SEQ ID NO: 138511 - DNA, 1065 bp, Homo sapiens
tgaaggcttagcttgtgccaagaagtgttaagcattgtccatgtatcatctcatttaatcctcacagcatatccctgtatgaagtaggttttgttactatctccatttcatagatgaggaaatggaggcttagagaggctaagttacttgtccatgttacatagccaatgagtggtagagcaggaattccaatcaaaatctatcttatgacaagcttaggtagataacggtggagccatctctcctcctttaacagatattttgtacttaattacataaaatataaccatgaaaagcaaaaatgatgtaacaacaatggaatccattgcactattgaagtggagttgaaatactgaaaaatgatcacactttgcactccttcttttgtcatttttctgactctggttctaactctaatattcccagtgcattggtacaaatctggaatgtggtatgctaatatctctgttactttttccctcacagtaactgactatactactggcagagttggagcacctcttatttgctgtgaaattaagctaaaagactggcaagaaggtaagaattttatgaaaagctctagtgattcaagatatgctgaaaactactgtcagctttatgactttcatttctttaaagtctggggaagcaaataattctctgctgttttgctgttgcctgtccccatgcattctttttcctcagtgatatctttaggttcccaagaggaaaataaaatctctagaatctaggattaatgattctgaacttgacaatacttgaaggtaaagagaaaaaaaattcttactggagctttctgggtttggagaaggtgaggatccttgaaacttgactttactagtgagaatgtttgggctgagaaaccccagatttttaggggatagaatgatgggttgcactcatacacacaccaacttcttagatcttgatcccagaaaagattttcatagttgagactcaactgtccagctatttgtatagttgaatttttatatgtacctgcacagacaagccacttagaagaaaactagagacattgat

SEQ ID NO: 138512 - DNA, 1965 bp, Homo sapiens
gagttcgacaccagcctggctaacacattgaaaccttgtctctactaaaaatacaaaaaattagccgggtgtggtggcaggcgcctgtagtcccagctactggggaggctgaggcaggagaatgggatgaacccaggaggtggagcttgcagtgagccgagatcccgccactgcactccagcctgggcagcagagtgagactccgtctcaaaaaaaaaaaaaaaaatttagattaacttaatgtatagaactgaagaaacccctatatctgtccttagtctttttgaagtagtgaacaagtagtcagtgaaattaattacataattaaagaaacaaatatgtccattatgctaaagacttttacccaagatgttgcaagtaaggtatcttcaactaaagactgtctccattcctttcagattattgaatattttgtttaactttcaggaaatcatggatagaatttataagaatgttatgagcaaagtccaagagatgaattatattcagaaaactctgttcaagatagggtatgattacaaattggaacagatcaaaaagggatatgatgcacctctttgcaatctgtaagtacatttcataggctctgtggtttgagcctttaaatttttttatgcttttaaatccagaagatgaataaataaatggcaagttaattcatttgaatatcaccaccatgatcataaggttgaaattctcttttattctaagtcttattgtttatacagcaagcagaggactctgatcttggcaatttaacaaattttaataattgagtgtatatttaagatttatttataaaatttagtttcatgaagaaaaactaaaatagacttttgaatcaagacacttgagcttaaaaaatgtcatttctaactaaaaaaagtgacctccattgcatgaaggtttctgatttattgtattcataaaatagtgtagtaagtatatgaatataacttattttaaatgtgatgctgaggagtggggatggggaagcattttttattggaagtgagataagataggtgattaaatgttccaaagataattaaaatttttttacctctgatgtctgttttctttcatttacttgtgtcagcatagtttcccgatgctacacattatctttcttcatttttaaagagttttttctggcatttttacaaggcgttactagttgttgccttgttaacctctcattctcaccgtgattctgacattgagatgttcaaccagttgaggaatctttcccagagcttataaattagtgtgttgccaagaataatgtatgcgtacattaaaatcatttatcctccctttattaaggttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaaggtaagcattattaatgtggtaaatattctgtatcagctgctactaataaaatacattcgcattacctttggaaaccatggtaactttaaaatacctcttaactaatatcagattcattgcaaatcagtgtagttttggtttatgaattcttaattataagtatcatgtggaccctttcattttaagccttataattttttttttttttgagatggagtttcactcttgttgcccaggctggagtgcaatagcataatctcagctcactgcaacctccacctcctgggttcaaacaattctcctgcctcagcctcccaagtagctgggattacaggcgtgtgccaccatgcccagctaatttttgtatttttagatggggtttcaccatgttgaccaggctggtctcgaactcctgacctcaggtgatctgcctgcctcggcctcc

SEQ ID NO: 138513 - DNA, 1678 bp, Homo sapiens
tgtgtaagcattaaggttgttattcaactcacagaatgatatgcagagtaccagtacacctagaaacctagaaaaaaataaattcagaagttgatgtgctcaaagacatttacgtcaataatgattacaaatggaaaatgccagcctttcagaccagttatttcagctttctgtaattaattgtgtaaactaataaagacctgagtatttaaatcaattgtgctatcaacttgttaatattcttttgtttttgttttttgttttttgtttttatttttcctgctctctgcttggttcattgtcatcacctacaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaaggtaaagtattttggtgcttttcatttatgttttaaagaggaagacacatttgttttatcataaatcgagtgcgttttaagtatgctggcattctattatagtgctgtgtaaaactactcagaagccgctcatagcttctgtatgttcatttaagagcatttttagagttttatgctttggatagtattttaattgcttgtttgaatatactaatattagagaatgtatcactttaacagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcgtaagtgccttgtgtttttggaggggggagaggagggtctttgcttgcatgtgagaattgttttgagatgctcttgttttcacagtaggtgttgtttagccattttacacattaattatgtccataatacggcatgtaatattgtggctaaaagatatccgatgactcctgttaagtatggtaacttgtaagaactaatatgggaattggcagctttaagggatgtgatttacacttttattttccaattggaaatgaattgtaactgaaagagttggagtttgggggtattttgggggggtgatatacaaagagtaatgattaaaagaacaaaaaaccatttctcaggataattcaaattcattgcttcactttgagacctcttatttgacttattctattttacgtgtgaaata

SEQ ID NO: 138514 - DNA, 2475 bp, Homo sapiens
agtcatactagccaggcacaggtgtaatgtgttggtatatggcatctctatagtcatcttaggttttgttttgcttttcttggttttaaaatgtatttattataattactgtatatttgagcttaaggtttgattgcacaagttatttgatattgaatagactgcttgttatttgcaatataacaatttgaatcagatgagacaagtgccgtaatgatacatatattttacatgattatttcgtcttgcagactgatgaaagatcttgttagaactcttaatgcttttattttcttaatgtattggcattctctaagttttaatgttaaagtataaagttaattgtaatgtctcttgtaaagtttgatttcatttacaaagtgaaaccattctgactcaacctagttgagctttctctggtatgttttacaatcatttggaagtttttaatagtgtatgaaagaaaataagattttaaggaagcactccacccctttacaaaagtccttgtgatgcaacatgtatttagaaatatgatcttttaaagtacagcaggtattcttatcggtttaatctcttggaacttttataattgttttctgatttaatgtttactagttacaactaatctttttcagaaggcaaattgtctctttatttggtgcttaaattactcttaaataatgtgtaacttgaaaatgagacttctaaaaaagtagcacttatatagttaattgttgattttcaaattgatttaaaaactatttttgtaagatcttatgtcaaggacaaagttaatttgtcactactgtatgtttcaacttggcagatgcatggatccttgcttggtttagttcattttctaaaacttttgaaaaaatatcttggcattaaccaactgcagttcagtagtttttctctttcattctcaaattggtgttgtgtcacatgcttctgggtaagacgatttcttcttttaaattcagactttaattaatatgtagtgtttgtttactttgtgtactagagcttaatgtatcactaatgctttctgtatttaacctatctcggagtgtttgaagtaactggaatgaaatacttattaaatctcacctcagaacaaaaaaataaaataaaattgaatctgatttttcactaaaacttctagtacttactggacatctatagaggccccccccccctaaaatgtcttaggatgtaggacagattagtgctcaaaattgttgccagtatttcttcatacccaaagtttgtcactctcacttatttagattataccagtattactaggatcacagataattgagctaaaaacatggactttaaaatcaaagcgacctggttcgaatctctactcagctgtgctatcttgggcaacttaatctctctgagtctgttatatctttaaaatgaaggtactacctcaaaggagttttctgaaggattaaatgagataatatatctgaaggacttagcacagtatctagcctgtagtaaatgctcaatacctggttattactatgattcccatatggaatggtaaagttcaacaggagcaattaactatccaatgactgaagataatgccctgcctttttctggctgacatacaaatacatgatttcaaggaagcaccactcaaagttcatgtcctcctaatgatgggatagcagtatcattcttcatacatggaaggacagcatacctttgtgaaaattatcagtgaaaatgcacatagtgcaaattgtgtaaccttcatgcttttataacaccaatcttttccaactctatgcaacaggcagtttttccagtttcatattttctattaagcaactaacaacatgttcaagtttattttaattaccagggattttaagagtatagtatttcctaggatgttgacatggacaagtgattgttttttaagatgattaaagttagctaccttcacgttattgtacttgcatatatttttaccttatagattcagaataattccagtacattcttaattcagtaaacaatttgattgaagccaacacacggaggcactgttccagtcacagattcagcagcaaatgagacaaactctctgccttgtgaagcttatattctactgggagcatagacagtaaacatgaaaaataaaacatggtatattagtaaaagtactcaggaaaaaaataacgcaagtaagggatagaaagtgtggggagtacaattttaaaagaagttggctggagaaatgcctcactgagaaggtgttctttgagtaaagaaaaaaaaagaggcaagagaataagctacgtagatgtcttggaagaacattccaggcagagagaacctcaagtacaaaggccatggggcaggaacaaatgggactgcagaagaatgttccagggaaagcgtactaggaggtgaagtcagaaccttggggtaggggaaagactatat

SEQ ID NO: 138515 - DNA, 1444 bp, Homo sapiens
gtttatgcttgccccgatacgttgaagcttattcttttttttttttgccccaagatggagtcttgctctgtcacccagactggagtgcagtggtgtgatctcggctcactgcaacctctgcctcccgggtttaagcaattctcctgccttagcctcctgaatagctgggattataggtgcccgccatggcgcctggctaacttttgtatttttactagagaaggggtttcaccatgttggccaggctggtctcaaactcctgacctcgtgattctcccaccttggcctcccaaagtgctgggattacaggcatgagccaccataccagcctgaagcttattctttgagagacagccacaatgtatacttgtgccgaagcttattgaagaataagcttcaatgtatcggggcaagtatacattgaggctgtctctcaaactgatttgcgtgtatttctgatcttcataaatttttaagtatatatttcattgaggcatctattctagactacaatatggagtaaaagaaatacaacagagcacctaaaattaaaatcatagtgtttgaggcttggactttgaaatttacctagtcctatagtccccgattgttgatttttagaccagtgctggttagtgaaaacgtttttactggtccatggtgaagtgagaaaaataaggacagcagatcatgagtttttaaaagctaaacattttcagtttaaaggattgcttcttatagaatatatctttctaatttaggggaattaaacatgttatttatctcatgaaattatggtgatagtaaatggtagggctttaaaaaaattcatgcctggcaaaacaacaacaacaacttggtagctctgtgtcatttccccccactaattctttcttttacattttttgctgttttgtgatatcttaaaatatgaacccaactttctcattttacagatgaggaaacagacattgagaggttaatttgttccaggtcttaccactcagcagcttgtgaaccaggactaaaaccctatatctgatactgtctctctagaacttctggtcttctgaaaattgctttcattataataggttataaatttgaaactgaagatatagtagttcttatgtgctaataactatttttgatttccaagtataaagaaattcaaaaggccatgtttttgtatagctaaatgctgaagtccactgattagcctgcattagaagaatcttaaacatggccaaagatttgtatcagcagatcagaattagctgtcaccgaattcagctacttaggtgttacacgctacccagtggctgacaaagaagttaaaatatcagcaaaattattatttccttttggaagttgacagactatactgccactgtgaagagtggtagtattcaaacttctatagttaatttaactacagaaagta

SEQ ID NO: 138516 - DNA, 1681 bp, Homo sapiens
ttagttaaagggtgaacataacttattaaataggactatacttttttaaagtcacaaatcaaatacctatacacggagatattttcttacaatgcatctgatttatcctatatctgtttaagatacaagtgtgttttttgtgagatgagaaattgacttcagtttgaagtcatcagttaaggtgttaatctagattctagaaattggattataaatgttgcacataaactaagattgtagtaatttgatatcattgaaaaacacttggaataaagagtcttgtgtgtttgtgtgattaatggtgtgcagctggtgctttcatttacttgcccgtcgtatatgactgtggattcaaacaggagtttttacttggaagtgtttttccaggagtgaaggttggcttctgctaatatacccatacattcttgccttgttctctatgggatgaaagttaggatacaactagggtcatcattaggatatttttgcaaaagaaagaggggtttgataattatgctgggacaaccacaggacagtcctcagaaagctgggaaatgtgttcacctacattttattttattttattttttgagacagagtttcactcttgttgcccaggctggagtgcaatggcgtgatcttggctcactgcaacctccgcctcccgggttcaagcgattctcctgcctcagcctcctgagtagaggggattacaggcatgcaccaccaggcccggctaattttgtgtttttagtagagacgggttttctccgtgttggtcaggctagtcttgaactaccgacctccgtgatccgcctgctgcagcctcccaaagtgctgggattacaggcgtgagccaccgcacccggcctcgccttcattttaaccagtttatctggggatcaggtttgtgactctagcttccgaagtactggctcaacccagtttagcgaaccatcagtgacagagagatttccctctactttggagtaaaagttaatttttgagaaaatattctgttgtattattatactggaattgtatgcgtagcagctgtattctttttatactttttagcattgtgaactccatgctgccagaccctgttggggttattgcaggacacatttgtagatgtgtgggccttacaggaagtgaaattacttaatgatattttaccactgctcgaaacatttcgaaagaaaaactttgagagaaagaaatgattcagccttttctgcctcctactttttgaagtcagctagtacacatttgtaatgtgatagcacagttgattggaatgtctgaagctagacaggtaagatgataccctttgaagtttgagtatttggtcccagaaccaggttgtaaagaagaaagtactgatggaaagctcacttctgaaatcccctcctttcacaggccctctgatcacccgtgtggaaagtagccctctgggtctactaatcacagacatcaaaggaatgatattcatttggttccttttgcttgagttaccttctcctggggcaggcttaatttcctgtaggggactgattctggtcagttgaaaaacattttcattatggggcagaaggttgcaagtatggcatggtacctattctatctcatgcagatataatctggcatttgagttcccatttgttttaataggataagt

SEQ ID NO: 138517 - DNA, 1051 bp, Homo sapiens
gtccttattctaaaagcttttttatatttttaaaattgatttttttctctttaaacttctgtgttaaaactaagacacagtctcaaaacaaaaacaaaaacaaaaaactaagacacaatcacaaacattagccgaggcctacaaagggtcaggatcatcagtatcgctgtctttcacctccacatcttgtcccactggaaggtctttaaggtcagtaacatgcatgcagttgtcatctcctataagagtgtcttcttctggaatacctcctaaaggacctgcctgaggtgcttcttgagaaggtgtcattctttttagaaatattgatatgtccatggtggtttgctagtattcttgaataatgtgccctgctgtgacttcactagtctacaggaatttttcatctccattatattcttatgggacgactgtatatgcagtccgtcattgactgaaatgttatgtggttcatgactgtagtttattccctatttttagatattttgttgtttccatctctttgctcagttaattcttcatgattttaagtaaaaggccaactgtgtgtgtcttctcaatcttttcccccctaacaaatgagaaatatgacactcttatcattacagtggctcaataagccagtgattctaaatgtatgtatattatgttgaacgacttgaaattgccttttttttttgtctgtagcaaattttttactattggcaattttatgtggttcaacctaatagcttgaaaaagatttctaggttattctgaccaccctgcacccctgtcccatctctcacttccctgagaatctgcatttagaatagtgagctgtttctgaagcctttggactaagcaacaatgttgacaaacttaccttccaggagtctctgataagcacaacatcctgaagacatatccttgtgttgatgacatatgcagagaactttaactatagtgacttgcatctgtgtgtcagtacggtagagatagacttctgagttttcacctaagctctgcaagagagcctgatggtcctctatcc

SEQ ID NO: 138518 - DNA, 1066 bp, Homo sapiens
cgcgaggagtacaaaataggggagttgatacttgcatcagccctgctagctgccttgaatcctagctcagtaggggtcactcttaagctgccataggcataacaacttctacataggtggcacttctggcactttggagaacattctagtggtgggatagttccctaacccctgtcttatctctgtggtaccctgcatctatgccatttttgtttggttacataaaatgtttctgtggagtgattggcctatgattgcattgataacatttagtaaaacagaagatttgttcctaacacgttttacagagctgatctttttattgaaaaatccctaaccctaaagaccacagttttttgtttgtttattttgtttgttagcctcatagggataaagtgcttccttataatcttgtttccaattgtcttcaactgaggaagaggaagtctgttgactgtctccctgcaccccctctgattgaaggatcaccttgcttagggcactgccagcttaaaagtggaggtggatgccatactaggacattaccaaagatgaggaggagtggcagtgaacttagagtctatagccagagtgtacattgaattttaaaaaccaataatctgagatctagtctgtacttaagagacatatttaaacaacaaattgtagactatgggatttcttttctttctttttttttttttttttttcttgagacagggtttcacttctttcacccaagtgcaatggtgtgacctcggctcactgcaacctccaccttctgggctcaagcaatcctcccacataagcatcctaagtactgggaccacaagctcatgccaccatgcccagttaatttttgtattttttgtagagacagggttttgccatgttgctcaggcaggtctccaacttgtgagctcaagcagtttgcctgcctcagtctcccaaaatgttgggattacatgagtaagccactgcgcctggctgactatgggatttcttaagctaagtagtatattgaaaagtctgcagtgtttcatttgatgatcagtctccagtgaaa

SEQ ID NO: 138519 - DNA, 1068 bp, Homo sapiens
ttaaaaaatcttctggaaagtgtaagacatcataacccagttaaaaagacaagtgatggccgggcactgcagctcacgcctataatcccagcactttgggaggccaaggtgggaagattgcttgagcccaggagtttgagaccagcctggacaacatagtgagaccctgtctctaaaaaaaaaacaaaaaaaacaaaacaacaacaacaacaacaaaaaacaacaaaaaaagccaggcatggtggcatgtgcctgtagtctttgctactccagaggctgaagtgggaggatcccttgagcctgggaggtcgaggctgcagagagctatgattgcaccactgcactctggcctgggtgatagagcgagaccctgtctcaaaaaataaataaataaaataaataaaaatgaaaaagcttctacatatgcattagaagctttaattgacctccacttaattgactcaccacattgaataatttttatttcctttgtaaaatacagtgtacactgaatacttggtattagttggttgatctccagtactccagcgtgcttgtttacctaccagtacagtaaatttttttactactaaacctgtatatgttggttgtatttgtttttttgtttgttggttggtttgtttgtttttgagatggagttttgctcttgttgcccaggctggagtgcaatggtgcaatctcggctcactgcaacctctgcctcctgggttcaagcaattctcctgccttagcctcccgagtagctgggattataggtgcccaccaccatgcctggctaattttttttgtatttttagtagagacggggttttgccatgttggccaggctggtcttgaactcctgacctcaggtgatccacttgcctcagcctcccagaatgctgggattacaggcgtgagccaccgtgctaagcctgcttgtatttgtttttaaaaggtaatttgtttaatatgttgtaacctgacaatatatgagtgggggagattggagttctttttactgaaaatttacaaatgaaataatatgatgtctgggatttgcttaac

SEQ ID NO: 138520 - DNA, 1333 bp, Homo sapiens
gggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccggtgagtatccctggatggggaggttgcggccccggcacccctgccctgtcggtaccagggccccatttccagagggggactggcgtacctcacctgagccgggaggaggttgggtgggcattccagctcctggagtcggctcgcttttttccttgagccagggctatctatccgctcgcctccgctggggccgggaagattcccgaggtcactgtatctgctcctgtgatggactctggggtcctcggaaccccagcctgcctcttcctgccgctcaccgcatcccgagggccagaagtcatcttcctgatcggggtactaggctttgccacggccctttccggaggagaccatgaagtgcttgctagacctccaaacgacctttagggtgcccctaaacctcaactccattttgtcccctcccagtcgctctgtaactgagggctagggagcctctctagccctagaggcatccgccctctcgaatttgagggatgccgtcgcttccgatatcttccttgcttccgatatcttcctagcttccgtaggcttaggtttgttagaaaacagctggatcctggcgaagcgtgctttccttccttcccccacccccgttctttctgtctacatccctgccttcagtgggtgctatatatttagtatgagctttattcacttcctcttcctctcgtttgagtgcctgaaagaactgtggctgatgtctatagacatagaaaaatctaggagaatatgattcattgtctaaccccatcaaggggttacatattttaaataagacgtcatttctcctcttcactccagcatctcctccttcaaaggcatttttcaccctcttgaaattaatacgctctattcgctcttttcacctaaaaaaaggtcaatcgtcgctctgagaaacaacagtgagatgcaaaataagggtaaaatggcattgaaatgaatccctttgaaaaagtaagcggtttgctttatcagttaatggtctcatcagcgcttcagtttcctcttctgcaaaaatcagtctgttgaactagagcatatcaaaggttccttctagtgttttgattctaggacctctaaattcatgcaggctgcataatgcaaatttaacctgattaaagccttatttctcatagtcgcttgtcaccttagtttttctttta

SEQ ID NO: 138521 - DNA, 1045 bp, Homo sapiens
agggcttcttgggaagtgatgccattcacaggaagtccagggctgtcccagctagaccttctgtgtaaatttgagccagtcttctttctttctttttttatgaatgggctttttgttaatgataggaaacaacgcatctcagccgatgctgtgtgaggctgtcgggacaggagtgcttttttaggatggcaggtggtgagggtcaaagggtgcatcttctacaaagtggtcttgaggcctctggcaatcacatatctagaaggtcgacaaaggactaaattcagcctgactggagctgcggctgatgtgatgacgtcaagactggcaacaccatggtttttagaagcaagatttttagaggctctcagaagactctggagacctagtgctagcattaattcattgtatgactttggagaaagtactcttcctgggcctcagtttgcctaccttgtgaaatgaggcagagttgccctcctagctcttgacagtctatgtgattcttgtctccataagtcgtagatgggtatgcaacagagagctattctgaaatgcttttgacctcctgtgtggaaaaaaaggaagctagtttcttctctgtggaagtcaggtggccagttcccattcattgttttctccctgtgtcttcccagtaaagtaaactcaactgggccatgcttgggaactcatgcagaggatgatggcactttaggactctgaagccttaggatgggggcatggaacagagccatgccgaggagttcttgagctccatcagaattatgcttctttgcccttttcccctaaatcactgctttgtatcatttaaatagtaacccctggcataccaggagacctagcctctgattaatccaactttctataccctccatatggcttttcctgggaagcaggaatgtatggatttttaaaagttgatgagtcctaaaaaaaaaaaaattaacagcagatggttggaaataattttctgtcttggttgcagcaatgaccaatgatagtatgtatacccagaataccataatac

SEQ ID NO: 138522 - DNA, 1344 bp, Homo sapiens
aacagtgtatattccaaagaggagatactatgtacaaagaaatgtttggcaagtgaactagctgaattaggctatgttgtagtggcaaattctgtggaatttagaagtcctagcaaggaaagagagatattagctgaagtgaaagggatagcttagcagagacatgtctgatatgtgtctctcaacaggatgactcagttttggctttataaaaaggccttcttcctcagagagtcagtgtaagtttgtaacaagggaggtattgctttaggccaggaaatagataagttggagggaaattggttagtctccgcatctctcatttttcagtctgcaacatattcattcccaaggccttgttacacaggctctcatcatagccatgctgcctttgagtgactgccaactgtagtagcataaggaagggcagtacttgtgtccaagttctgttattgattaatattcgtcctgtcagatttcattttggccttgtctgatttctcaaacgtgtcctgggactgtagactgatacaggcatgtatggttgacctagcactgtctcacagctaagcctccagccagagatatttgagtgttctcaagatcagcaagcaccaaggttaccacatggttgctaaaccccttgctaaatatcactggtgtctatcaattataccaataagtatttcttcaagcatggccagtccctttttgcttatgattttggcaggtatgggtgacagggagtgaatttatggagtgactgtactgtttaccaaaaatcacccagtaagttagtggcacaggtggctttagaactgagctgccacagtgggaatctggcttagcaggaagagattctcatagctatttaagtcttaaaaatctacagtttctcagcagaagggttaaaatgctagatagtttgactgattgttgtaaagactggtggtcttaatttagtggccctttaccctccttgagtccagttatatttgtcttagaaacttaagaaaaagatcccatttgggatgtcttgtttaattgtccaattcctgttggttctgtatgtgtctgtgccaacatctcctgattaggcacagaacttagtggggtgaagcatatgcagtttaaccctccatgtctatgcgcataaggcaggctgtatccaggctggatatttggcaaagaataattggtgctgttgaccccttagtcccaagctgttggtttttagtgagtaacactgaatcccatccttttttagagttgctgtagctatttgattttttgtcttctttacaatatattagaaatctaacttcaaccaaatatggcttaccc

SEQ ID NO: 138523 - DNA, 2718 bp, Homo sapiens
aggaagtatttttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgtttgcttttctcccaatcaggaaatcacactgttggatcttgatcttaatctcttggacatgccaactttcttgcttcttaatatcatataaataaaaaatgttattaagccagagacttacttttcctttttctcccctcttctctttttcagtggatacctcattgttatgcctcattgaaatgaagagctaggtttctctgcttctcctggtctttcatatattttgttaaattgagaatgtcttgtctcacgtgctcctctcctgccaggaactggctgagtgaatgcgaagagactctggatgtggaaagcggtgattgtcaaactttatttgtaaaagagtctcttggaagcttgttataatgcggataccttgttctctacatggtgattctgagcaggtctagggtgaggattggaatctgcatttatactcgctcttgggtgattctaatgctggtcagccttggaccccacttttagagacattatctagtggctgaagtaattaggtgggaagttggtttcagtgcccatcctaattgagcatgagtctgggtgatctgtgggcaaggcattaagtgttctggcaccatctcaatacctgttaaatagtgtgattcagattagaggatgagggccccaagttattgtgaagagggttttaaggtagctgtagagttccactggcttgtttggtgactgttagttatgtcaatggagtatttcaaccaggccacctttattaccttccagtgatatatggaatatatccctccagtccttctatatccccccgctttccagtctctaagatctgcagggactaacaagagggaatgttgacacatggtttgttgtatgctaactctctgtttgcaggactgttgttttagatgttcgtgggagtttattctttcttgcgttcactcaacagatatttatcgaatgcctattgtgtgccaaacattggtgccaggtattggagattcaaagagaaataagaagcagtcattgttgatgtactttcaaaaacaaaaccaaaaacaaaaaaaaaagaagaagtagcctttgccttcattttgttcacagttttgatgagatggacaaggaaatagatcaactaaattacaacattacatgtatagtaacagatttgaacaaagcataggggacaggggtctttttttttcctaatgcaattaaggaaagcttcctagaagaggtggcatttgagctggctcatgttagctccatgaaagcaaggacccttggtttttgttctcttagtgcctagaacagggactggctctagtaggtgctcaataaatgtatttgaatgcgtaggaattcattgggtgatggaggaaggaaagcaattctaggcataagaaacaataagtgcaaaggctatgtgctatctccccatttctcctatttaatatctattcacttacccagggttcaagtagacaggaagaggatggatgtggagagcagtgattatcaaactttatttgtgaaagaatcccttggaagcttgttataatgtagatgtctagctctcttcatagcaattctgagcaggtctaggatgaggatgggaatctgcatttataagaaactcccagatgattctaatgcctgtgagcct

SEQ ID NO: 138524 - DNA, 2157 bp, Homo sapiens
gcatcaaggcacttggacctgttaccagcatgagatcctgaagggaagggtttgggggatctcttgattggttttggttcccgtctagtagctgctggaggaaatggcagagggaggaaggataatatgagttttattctgagctgggtggtgttgagggaagggaatggattgcaggagccaggaggtcagacaggattggcctgtttggcgaaaacagtgcaagctctgccctgtggccatgtgtttaggtgggtaggagagggaggagtgagatcatctggaggggaaaggaagcatggtaccatcctaattctagcccagtgccttcagtctcctcatgtccatcacatgccagtattggtataaagtcagggtgtattttgcctgtgaattgaattgtctttgccaatcgaccagctgtgtttgcagaaagactctgactgactgtgttctggctgttgctagcaaagagacatttcattcaggtgctgattaaataaggtgcagagccagattgcacattaaggcccttaactatggctctgggagtcctgggtaaacacttattagatgttctgggcagagcacaaaaaggctggtagtcaggtgttctcttcagaaatcaggttgaaggaaaatggggtaaagagagacttctataaagagttttgatcttcttttcttaacattaatcagatctgagtggctggtgtgtacacatcagggccagataagtttcctcattggcatttacttgccaaattcttgctgggacattgtaggcttggactgggatacagcggggatcctgacttaagtagggcagtaggaatgcttcattttcctaatgcaagttcagcttggtggatagagcctttggaccatatttcctgggtttgggtttgagctccatcaccatgtaaccttaggcatgttacttagctgcatctgtaaaatgggaataataatagggttgttgtgagggttaaataaaataatttaaatcaagtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgc

SEQ ID NO: 138525 - DNA, 1801 bp, Homo sapiens
ccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttgaggtcttccaagttcattatttttcttgtttattgctagaccagtatacctaaagcctctgggtctgttttcttatctgcaaaatggggattaatagtagtatctactttatggggttcttgtaagaattaaatgcatgactacatgtgaagtgtttagaatagtggtgcatggcaagtgtttaataaatatgagtatggctgttatcatctgtaagacagagatgatctttgcccttcttaccttatagggtaaatatgagaatcaagtcaaataaggtatgtgaatgtgctgtgaatatatgaatgtgctgtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgacccaggttaaatccctagaaaccttgatacatctcaattccaccctcttcctccttttcatcatcatagtctcagtcatcttgattctgcctttcatgatctcttccatttctcttccttttcttctttgattcccctgccctggttcatgttgttgtttatcactgtcatcatcatcacctgtcttgttagagcagccttgtgattgatcttctctcctctatcctttacactactctatcctttactcta

SEQ ID NO: 138526 - DNA, 2358 bp, Homo sapiens
attttggtcccaaccttttttttcagccttgttatttagtatattcttccatgtgttctctgatccagccaccagcaccatgcacttccattcttctctgagtttatactttgtttatgctgcactgttagacagaaatattctttcttttctcttcctgttgaaatgctagttatcattcaaggctcagcccaaacactccctcttgtgaagctgtcttcaagcctctaagccggatttagcctctcttgtctattttagcatgttattctgccttgtattatgtaattgtttgtgtatcttccctactccttagattgtatgttcccaaatgtaaggtctatgtttttattaatttttgtatcccccgcacagcttctggtacattctagattcctaattttttaaaaattaagtctagtccaatccctttgttttccagatgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgtggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaaaaaaaaaaaaaaaaaaaaagcccaagcagcctctttatatgtgcatgtttatgagcacattttaaaaatctggaagaatgtatactaaatagcacttactcctgagtgattagggaaagaggggaattctcattttttaatgaccacatttctgtattatttgaatttggtttaagtgtagattcctttagtaattaagagaaatacttatttaaataaagaaaggatgattggcagcctgtgagaatagctttactaaaaaagattcaatggacaaaggaagccaactcacgagagaacatttggcaactgagaaaacatcatgtgttttggaggctgtgccacaggtgccttgctgtctgtgtggctggtgggggtgaggcagggggcatggagagattatggctggaatgaggcagttaccccattgccaggaagttcagtggaaagggaggggataagtagaagagtagctaagtggccaagaggcaggcaggggctgattaagaaggaattaaaaaagcaaatctgtgtgtgtgtgtttgtatgtgtgtgtgtgtgtcagacagtcagattcagtgctgagctgcagagggagaaggaaggggacactcattgctatgaggaaacatcagtgtgaagcggggagcagggtagttgagaagggacaaatggaataccaattttagtagtagggaagcttccagaaaagcatgagatctcaggccaattaagcctctgatacatgtaatggttggggactaggctggactagctaatcgccttctctaacggtaggttaagaaagctcctttttgtttatgttttggttacaaaaaatgttttggcagtagcagacttattgtactggctcagagaatagtctggtgagtgactgaaatggaatttttgtgagcccttgaaggcctttaagtcatctggacctgctaaagtttgggactagaagtggagatggagaacagtggaggtcagagtcctcaaccctggctgcatctctcagtcacctagggcagcagataataaaacacaaaccaatgcctgctcccacaccctgttcttagataattgattacacttggggcctggacataggcatttaagaaaaaactcctcaagtgattctaatctgtagccagggttaggaatcaatagttgagaagactggattaaatgtgttctgagcctaaactgaccactagaaatgtgt

SEQ ID NO: 138527 - DNA, 1018 bp, Homo sapiens
ggtgtgtgagtaatgagctgtatgctgggtgtgggagttcagtgcccagccttcgggaaaacatgggtaggtttcattggctcttatagcagtttgtggctccctgactctatctaccctggagatgtattggagtccaatagttagaacctcagagccgtgggtaataggcctattacctacttcttcacagtaatgataacagctcacatttattttgcccttactttgtgccaggcattgtcctaagtgccttatgcgcatgaactcatttaatcctcacaagaattctaaaaggtagggtgcagagcaactaaatagcttgcctacagtcacacagctagtggggtggagctcggattagaaattaggcagttcagagaccataaacttaaccaactgcttggttgagtctctagtcctttggtttccttttttaacttaacatgttataattttgtaactgctggtctttagaaatgcagctgatctttgtgcatcatttttgtatccagcaaccttgctaaatgcttttaagttaattataattaatacatctgaggattctttgggttctctatcttggcaatcgtacataatctgcaaataatgagaactttgtctcttcctttgtggccattattttttttaatatctttttctcaacttactgttttagttgagacctcccgtatagtgcttaatacaagtgacaatgttgagcaactcttatcttgttttctgccttaaaggatatgctttcagtgtttcatcataaagtatgatccttactataatttttttgttggtattatttattagattatagaagttccctcctattctaagtttgctaagattttttaaaaatcatgaatggatgttgcattttatcagaagctttttcttctgttgagatgatcatattgcttttgttctttagtctttcagtgtggtcaattatactgattgattttctaatattaaattgtctctgtacttcccagaatcaagtcac

SEQ ID NO: 138528 - DNA, 1039 bp, Homo sapiens
attgaaataatagttgcatagggattctaaataatttattagttccctcacttgctctgcaggaaacaaaaataaagtctatagaagacagtgttcacgaggatcaagcaacagaaatgatgtcagctattcccccttttattagattttcgaatggaatcagactatgtgaagctggaaggcatacagagagacaaattacatttggtcacatatgggtgggaatggaacttttcagtccagctcttgagcctatgtggtgctgtgaaatcttattttcatgctctgttagggcagcagctcctgattctgattgcgtttcctaaataagcactctgagctagtcctctttgctagcccttccttgctactcagagagtttcaatgaagggggagcaggtgacccagttagggtcccttgtttcaggtgttctttcatttgaatgtaacaatacttctctgtctctttttttaaaaaaaactttattttttgattatagaagtagcatatgatcataaattaagaaattagaaatatagaaatatagaaaacaaaagtgaaagtttctggtaatctgtctccctgacctgttctcttctctccctttttctctctctttttctctgtctgtttttttttttttttttttttttttttttgaggctgggtctcactctgtcacccaggctggagtgcagtggcatgatcatggctcactgtagccttgacttccctgggctcaggtgatcctcctgccttagcctcccgagtagctgagattacaggtacatgccaccacacctggctaatttttgtattttttgtagagacagggtttcactgcgttgccgaggctagtttgaactcctgggcttaagcaatccttccatctctgcctcccaaagtgatgggattatgggcatgagccatcgcattcggcctctttttttttttttttaacattttttttcgtgtttttaaatgtgggttttattattgttcagatgtgaaaaggccaacggatcaagagacagttgc

SEQ ID NO: 138529 - DNA, 2440 bp, Homo sapiens
ctttccccctacctttccccacctctagtaactactactgtactctctacttctatgagatcaacttttttagtcctgctctttttttttctttttattattattattattatcattatactttaagttttaggatacatgtgcacaatgtgcaggtttgttacatatataaagacctcggctaatgtgaaagaatatctccttctcactctctgatcttttcctttaaatttgcatttctcacaaaagtgtagtgtgaaaaaaaatccagcttgatgggggagagggctccagattttacagaatatggctgcatgaagtaaaggtcaggggttgaaggaactggaattaaaaatgccaattactcatctttatttaaaaatgggtaaatataaggcagaaaataatattttaggtacacacatcctgatctagctatgtttatgtgtgttggggtgatggatggacaagaggtatagttcaaatgagatcatttttgtgaaatggctttgtaaactgtaacatgccctataaatatgagattagctttaatactggccctgactctccagtgtggctttgtgtgtttgtctaaacacttagttaatatctgtcagtggtccattgcacaaggaactgacacaatggtatcctgtgcctctgttgttgttgttgttgtttttttttgcagttctaaaagcttagttaattgccttcattagcttaatatataccacgtgaaaagcatagaaaagcagaactcaaaactcagagaataaaggacagaacataactaactactgatgtgcaccttagttacctgatgcagggaattgaagcatataagcttcatctagtactacctcaaatacagtaaagtggatgacagcactcgataaactgtaaagctgaataataatgccaaggattgttgtcatcatgactacttagattggctgtcacccagtgacttagctgtgatatgcttccaggcagttcctgagaggtcctgcaagcccctttcctgtacaggtgctagaaagtgccatagaaatacagtctcctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatataaataaattcaaagaaaaaaaagctagcagaattacatgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactag

SEQ ID NO: 138530 - DNA, 1340 bp, Homo sapiens
cattctcagtaaactatcgcaagaacaaaaaaccaaacaccgcatattctcactcattggtgggaattgaacaatgagaacacatgaacacaggaaggggaacatcacactctggggactgttgtggggtggggggaggggggagggatagcattagtagatatacctaatgctaaatgacgagttaatgggtgcagcacaccagcatggcacatgtatacatatgtaactaacatgcacgttgtgcacatgtaccctaaaacttaaagtataataataataaaataaaattaaaaaaagaaatgaaaaaaataaataaaaatcactcatagtcttgccacaaaaatgttaacatttttgcttattctccttcttctcttcacattattttacatgcttgtgtctatactgtatattgccaattttatacctgatttttttcactaagcatcctcataaacgtttcctgtgttatttaaaacttgttggcataactcttaatgcctatgtggtactccatcctgtatgtaactggatcataatttacctagccatttcctttttttttttttaggggggatggattcttgctctgtcacccaggctggagtgcagtggcacgatctcagctcactgcaacctctgcttcccaggttcaagcaattcttgtgcctcagcctcccaagtagctgggactacaggctaccatcaccgcggccagctaatttttgtattttttagtagagatggggttttaccatgttgtccaggctggtctcgaactcctgatctcaagtgatccgcccacttcggcctcccaatgtgctcctatttttttttttttgcagttataaactttaaaaagtttactcttgtacaaatctttgtgtttcacattattttgtaggtcactttccttgaagtggagttaccaggacaggggtatggatgtttttaaggagcttaatatctctttttttgttgtttttttttaaaaaaggtagtgcttatgtacattcctactagcagtggggacagagagagcctcttccaactcatcctcaccaacatcagatattgtcactaaagcaaaatcttttttttaaagcaaattttaaaaaaatggcatctaagttaatgtgtaattctttgttaaggtgattggagaaaaagtttcaaatgattgttgaatgatgaatgggatcacatagttcttctttggctcagtttttcataaatgtaccttgggccctaacttgcttctccttttcctcatgcagttaccccctttcatctttctggctccttctgttaaaattctacttattctttagggctca

SEQ ID NO: 138531 - DNA, 1055 bp, Homo sapiens
ggtaggataaaggcagagtacaataagctggaatacctagaggagacatatggacatgatacgattggtgatagggaaccattaaagattcatgaaaagaggagtgatagatgagtgtggtgttgcaaggtcacctttgccaggcgtatgaagctgctgggaaaggatgtgagttattggcccctccttcagtggatagggttgggcagtagtgattcacaaactccatcaaaacccagccacatcagaaaacacaaatgatttatttttgcattagcttccagttattgtgtgccttcctgtggttcagatatacaccaccatatattgtggagggcttgtagctggggggctgtggagaatggccgcctatgtgacaggaggcaggccagtcacctctgcttagccacaggcaaaattgccatctgtgaccctggtaccttgaaaggtgtgtcttgaatggctctttgactcttcagaaacaatctgggagcccattcattctgttctcacttgcctgcttcctttaagggccgatagcaaatttctaattttactgttaggagaatattttcaatctcattttttaacctttaaattaagttgaacctttcaattaagttgaattaatatttcttcccactacctactccttactgccctcactccgtcctttattagattgcttatatttccataactgcatcgtgaccttagcacatggacttaatcattaactatcgtattcctaaagaacagcctttggactcattttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagaacggggtttcaccgttttagccgggatggtctcgatctcctgacctcgtgatccgcccgcctcggcctcccaaagtgctgggattacag

SEQ ID NO: 138532 - DNA, 1029 bp, Homo sapiens
tgacccacttgcatcagagtcaccatgtgtgctttttaaaaatgctgattccttccaccttgaatccattgaaggaaaaatgctaattcctgggccctatcccagaactattgagtccggatattggagtgggggacagaaatggcttggcttggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaa

SEQ ID NO: 138533 - DNA, 1760 bp, Homo sapiens
ctttcaatttgcagcgtccccagcccttttatccatctcagtgcttccctggttgggaacaaaacccaagctccagggtcagagcacatacggaggaagaaccctttttgaaaatccaagcacatgaggaattcatgtttcattgtcatcctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtttcaaatcacagaagacctatctctttgtgctcccagcttgttgtcttggttacaggcttcttcagcttgccttcctttgaggggaatatacagtgtaaagaagattttttaaaatggtgactaaggtccctttctctaaggttactgggatattaagcagtgggtagaacagtgacttgtaaacccggctgtacattgaaatcagctggagcactttaaaatactgatgcccaggccccaggcccaaccagttgagtaggcatcttgaggagtaggccccaggaatttttttttcttttatgaaacaataaactgcctacgtgagtctaatgtgcattcagtatttagaactgctgggttttacagcaaagccaaacaacttggttctggctgtttgagccaggtgaaggaaatagaatcaacttttctgtaccttagttttacctgcctagaacagagaagcactaaagcttaagaatttaaagaggcttactgtgacccccctgtcattattgttgcatacaaaagagaggtaactttctttcaaaaaaaaaaaaagaaagaaagaaagaaagaaagaaagaaaatccagttattcagctggcttggcttctgggctgtaacagtggcttgaggattaaaagaaatctttccagttgcttgaagaagggttatctgtatggaggaacagcagcttcattcccagtgtggtttggacagcgcattccaggttttcaaacctgcctcagcttccagctgactcccttctcatgccccaggtggttagcagagttaggcaccatacttatatttttagtgaaattgccttttaatagtattttcctaacataaaagcaacagatgttcatgattcaagcccggaacattataggaatatgacacatagcaaacaaaagtcccctagaagtcggtctcccagacatatccattgtaagcatgtttttccttctgatttttatctctgcatatgctaaacattttatatttttattctaaaaatgggatcattcaacaatgtttgtatttttttttccttaatatcttagccatcagtccatgttagtacatataaatcaacctcattcttaaggacccctgattcttaggattttagtcacacaagggcacaatctccttccgcttccctccaagattttgctttcctatggaaaggcttgggttttgtttgtttctttgggcttcaaatagagcaaatccattatatctggtatatttatgtttggttgtt

SEQ ID NO: 138534 - DNA, 1053 bp, Homo sapiens
actgcaccttccgccttccaggttcaagcgattctcctgcctcagcctcccgagtaggtggggctacaggcatgcaccaccatgcccagctaatttttttgtatttttagtagagacggggtttcaccatgttggccaggatggtcttgatcttttcacctcatgatctgcccaccttggcctcccaaagtgctgggattacaggcgtgagccaccatgcctggcctacatgcatcattttttaaaacagtgattaatggagtcccctttcccaattttttaatacaaaggtgtggatgggagatttgcagcaaagataggaaagcaaagatataacccacaatctttactcttgccaacagctcttaccttctttcccaccaaaattttcctttgataaaatgtcttgctgagagttaggctaactcaccaaccagctttaattttggttgacagggtgccgtagaagacctttgctagccagactgtgagcttcttgcagacaggaattatgtcctgcatcactgtgtgctcagaacctcaggaagaacaaactgatgtaggcaccaggaaataggtgcttttattacattctcattttatgccttagaagcactgcaaatggtaggtattcttatttctgttttaaacaatgagaaaactgaggcttaaggaggtgtaaaaaatactttcttttaaaaaaaatacacctctcccccaccatcataaaaaccccaactttggccatagagttcattggtggtggagcactgcaaacattagctgtcccatgtggctttgactctgacacaattggtcctcttgcttcagggaactggataccatccatccctcccatgggttggcctaggctctgttacttcagagttttcttgacgagtttcaaggtaaccaggtcatcctgttctacatatttttctgggattgaggtcaaggagcagcatgatcctctcttaaatgggtcagaggaggaggactcctgtggctccctgaaaggtcaagccccttcatgctaactacaccgtcttccct

SEQ ID NO: 138535 - DNA, 1053 bp, Homo sapiens
gcagcagaaaacagatccttgtatattgctggagggaatagcaatttaaataatttttctggagggcagtttagcattatgggtcaaaagccttcaaatggatattccctttgaagatctagactgtcttctatcaatgtgggctaaggaaatagtaaaggaactgaaaatttagatgtaatttacatgtgcaaccagaggatattggttgagtaaattattgcatatccatataattgaataaaatgaaggtattggaaaatgagatagtagaagtgtagtaattgacacaaatacgttcagggtacagcttgacataacgcgcaaggctgtcatgctggagaggtaggcaggatctagagcaaagaaggccttgtccgccatccgaagaaccttgagcttttttggtaggtagtggcaagccatggaaggatttaaaatggcagatcagaggggcattttagatagatccctcttgtagcagtgtgcctggaggcaggagaccagtaaggaaattattgcagtggtcctgaaagagatgatgagggcccaagggtatgaagtagatggagtcataggaccaactttgggcagcccagagagttaatcttccttatggtgggtaacagtcataagcacttggcctcagcgatccccagatagctatgtgccatcccaggaggtgctgacaggagaactggagcttggggagattgtgtgctaggccaaacaccactctcctgtacctctctcactctgtttccctttcatttagtttgcccatatcccttcattgcttaccctggctagcctctcatttaggatggcctgtggtcactggccctccttcccaattacatttctcatagtactaacacttgctccagtgtacaaaagctatcttctttaagtgctatgaaaatgaggattgttgaatgtaacactggggtggagcagaagtggatgggaggctgaacaatggtggcagtgaacttggggctgatatgactgggggaacaggaatgggaagcaggccaggtgttggctgagagg

SEQ ID NO: 138536 - DNA, 1018 bp, Homo sapiens
tgggtgttgcttgttagacatgcagaatttcaggggccacctgcagaccacctgcatcagaatgtgcattttaacaggactcccaaggtagcttatatggactagaccttttctgccaaggaccccaaagcatcttacagataaagcatttgagctctcgatggaggggaacatctgtgttggggagggcagggggcacagcctctgtcttaatagtcagggtgcacttggttcaacattcccctgtgagctgggatcagtaggcacaggccgctgacacaggcactgttgccctgccttctacatctcccacagtctgtgacttgcctgacttcacctggtggactgtagaatcagaactcctgacttggtctcagagttagatggggtaattccaaagaatggtaaaaataaaccaaattgggaaacttaacaaaaaacggtgaatttcccataccacagcataagtccttcctgcctcagggttgtggaacagggttggagcagaagttacttcctgcttgtggaggtaacctgctagggcagaaaagtagatccaatgctatcttatcatctctctgctcccccttgtacctgttttctcaggagactgagaagtcaggcagatagagagctgctttctcaaatttcagcagctctatcagatcccagaaaaggaaggtgcatcagaaaatctccccctaggctaatagagttagtgatcctgaattggggtgtttccagcccacaactctggccaaacagcacctgctgaggtggatagatatagttcctctagacaggccaccttcagctctctttctagtaggacctttcccccagtgaaaaccaaatatccttcttcttgcaaagccattgaacataaacagaaattttgattctcattgtagaagcatgagaatgaaggccccaaaatgctccattacatacctgaaatcagttagaaagctggtggtgaagttttcattcagtcaatattgttacacaaaaggtacat

SEQ ID NO: 138537 - DNA, 1046 bp, Homo sapiens
ttttttttcaaccacctaaaataatgccattttcttgattacaacaaaagacatatttactgttgaaaatttgtgaaatatagaaaagtataaattttaaaaaaatcatcaccaatgcaaaggtgattatttttctggacactgaaaaaaaaggtggcggctttgtgccttttgtctttatacatttatgtatcatttctttacagaagtgatatatgttcaaaacagaaaaaaatggaggccaggtgcagtggctcccacctgtaatcccagcactttgggagggcaaggcaggaggatcacttaagcacaggagtttgacacaagcctgggcaacatagcgagaccccatttcttaaagaaagtaaggaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttag

SEQ ID NO: 138538 - DNA, 1050 bp, Homo sapiens
catgttttttgtctgtaggggccactcaggtccttcatattccaataatacacatgggaaaccaccaaggggatatattatatactacatctcctaaatttttaaccaaactttcttagtggagcatttacaagtaccttctctacaaaagacatctaggaagatcctgatctagatcagaagaatattcattttgttcttttttttttcctgcaattgtaaagagaagtgaattggtgaaatgcatgggattgctgaaatatgggtcctgaacagcaggggaggtcaactttggactctgttgaaatgaatgcttcctgctctaaaacacttctctccctcctatcctcacagctcccctttgaattggagatttactacattcagcatgttatgctctacgtggtacccatctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctat

SEQ ID NO: 138539 - DNA, 1048 bp, Homo sapiens
ggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaat

SEQ ID NO: 138540 - DNA, 1044 bp, Homo sapiens
ggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctcc

SEQ ID NO: 138541 - DNA, 1051 bp, Homo sapiens
gtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagaga

SEQ ID NO: 138542 - DNA, 1063 bp, Homo sapiens
ggctttcaaacttgagtgtgggtcaaaatcagaatctctaggagggcttcttaaaatccagcttgctgggccctacttcagagtttctgattagagtttctagtagatctagggtgaggcctggaatctggaatctgagaatttttattaataacaggttccctggttaggcagatactactattccagggaccacactttgaaaacaactgtcctagggaagttgtggaaaatgcagcttcctgggccctgccccatagagttgaatccaggaagtctgagtgggccctggaatctccactgtagtaacaagcgcttcaggatgatcctgatgcttgggtcctccaaccatataggagaaacactgacttagagggaatcctggagctggaagatgaaccaagagacctgggaaaagctgccagtgaaggggacagagtctggccaggtgtgaggagcagtgtctcctggaaggtgagaaaattaaggcagaaaacacttgacttaaccatttgctcccacaaaggactcctgagcaccaatcacttcttcctcagcagggacaatccagtggtcttcagaaactcacctacccacctgttgcacaaggctcagcccttcgccaatcagtcaaatccctcaggtcccccctcatccactaaccctttaggagcctcaggatttaccagagttcctatactttcacctgcccttacctgaccagtatagtggagcagggaagcctcatggaagaggggaacttctctaacatcctaacactagctagatgggaggggcaatgggctcaatggtatggaggagaaacaggaaactcagcctggatactgatgtcagcatgaccttggggccagtttttgagctgccattggccaaagtacttccgctttaactggtcccagaaagtaactagcacaggaggtccaatcctcatcctccagaagatgagctgaaagcccactcaagagagaggtggcctgcctagaacaaacaacactgaggttcttaaccccagtttcttgaaatgtcctccaaaaacatctga

SEQ ID NO: 138543 - DNA, 1088 bp, Homo sapiens
taggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatg

SEQ ID NO: 138544 - DNA, 1324 bp, Homo sapiens
cagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgcc

SEQ ID NO: 138545 - DNA, 1022 bp, Homo sapiens
atttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaacccaggagtcctggcc

SEQ ID NO: 138546 - DNA, 1150 bp, Homo sapiens
aaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccgagttatcattttatgtttcttttttaagtttaacctctctcatcataggatcttggtctcgtcggtacttcttactaaaaggttaacagttgaaggctctgaaggaatatagttaggaacagatactgatttattgccaaactagcacttgggaaaccttacctgcttgtagccactccctgccatatgatttgccaatgtcatccttttgtctatctctgaatcctggcttgctgatatagattagcctttatttggacaccctaacctggccacattgatcctttaaggatccttcagatcctttgccacagaactcaggcaaatatcagacttgaattctggcgggagcttagctgtgcttaggtccgctccaaatcagtcagtggttattgggcatttcctctttgtgagctggtgaggggcagtagcagtgctattcagttaaatcatctga

SEQ ID NO: 138547 - DNA, 3345 bp, Homo sapiens
atgagatgcatactcctgttagaaaactggggctgaggggacaataaaatttttaaaagaacaatttaaacaaggagtagtagagtgcaaagagcactggactcagacttttgatttccaagttctgatcttagctttgctacttactatctctgtgaccttgggcagtcactgcttctctctgggaccccgtttcctgatctataaaattatctttaaggtccttcctagcagtgacaatggcatgtcacctacttctcaatgttaacttttctcttccctgactttctttcaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcat

SEQ ID NO: 138548 - DNA, 2584 bp, Homo sapiens
tgtgtttgcttgcctacgtataatttaatgttttaaacggagtagacagtttgggaggggatcagcaccaaaaattttggaacttaatcagaagtggtgagtgtacctgcaaaacaggatggttgtttgctatctctttgaagtcagtcacctttgtctctagttctttattggcatgagctacaatttgggagtggggcaggatttttgccatcaaccgtcttattctacagacagcttcagaatagttgttccagttttccaaacatagtatcatagcctagtgcatgttgggcacatgcaaatcaatattttccctctccgtggccatcataatggccttcaaatccaaagtcaaagctttggaaagagaaaacttatacgtccttctaaaaacaaagggaaaggaagaactgcattctcttgaaagttaaattataaccttttctttctgattctatgaagaagactgtactaataaaactgccaatttctttcaggtgggtgtacatggcattagaatagaattcatcaatgaaaaaggatcaaaacgcaccgccacctacctaccggaggttgcaaaggagcaaggtcattgttgtactttatttcatatgatctggtgaagaatttaaacaaatatacaaactgaaatgcgttatctgaccttgcagttatgtctaataattgaagtgtcaaattataagaagtgactcttccatcactgccactgcaatgtctgtatcaagtcggtgaagtactcacagaagttgaatccctgcattgaagtttgatggcataaacccataagtgtatattttttaaaaagcagaatttatattagttggttttcattttaggcaacaatttgctaccgatttgaaatgcatttttcccatattccattgtggcataaacaagccttttgtttgacaatcagccacatagttctttgtcattttaagtatcaaatgtttcattcttaggtggttgccattactcatcctgctgatactaagattctaggtttcccactaagatcagaggattgcgaaaacatgaagtgttagtgttttatatgcttggtctacacttcctaatcagaattttcctgtttcacacatagagcatagacctgtatgaaccaacattgtaacacaaagtaacttttcactctgtagtattttatcctttcttagcaactactaaattctggtttcatgttggtcgaaatgaatcttttatcttggggagcttttcttctcatcagaaagcatttgtaatttggttttcccgtgtttgtcttataaatgtgagatacataatagcaaaattaatgccattaaatccccagatcagaaagtcttcaaggcagttacttgaagatttatttgggttgctttagaaaatgtcttaatctcctagtatcattaactttgtaaagcatacataaaagatagagggcctcagatactagtataccatccatgtcagaactaatcaaaatacccttgaatactgcacacaaacttgaatgattacagaattacagaagataccataaggaacaacaattactgtgaggtggtgtgggagtcctaaatattgacttggcaaaatggcatataggcttttcactcccttttaaagatgtcactgttagaggaaagtacaacagatatggtttgttacagtcatgactgagcaatttctgccagccccttagaccccttgacttcgaatgcgaagataaaggagccagtgttgtttggcattgtggatagctagaatttaaggagtgtggtgatgaccctgcttttgtaaaggatgaaatcttagcttttctgtgtgattgtttttaggaccaaaagatttgatggcatttggtgacagtgatagctgacctctacaaagtcattttgtatttaatgaaaggtgtttgttacatgtgcttgactgatattttatctggtcatctctctacaggatgggaccatatacagaccatagactccttattgaggaaaggaggatacaaagctccgattactaatgaattcaggaaaaccataaaactgaccaggtacagaagacattttctagcacaaggctaacctgtacattttgatgtgtatgcctataaccctttgatttctttggtctctctaactacacttcttttttctgaaacagagtggaaatgaatggcagggtcatactgagggtggatacaatggaactctgcttcgtagtaaagcctgtgtgatgtatgagcctatctttcccatctttagctctgtgtgattactctggcttttgtacgagcaagcccttggagattttagactactttattggagaaagtacttgaattagcaattggctagcttttgacattactgagcagaaccccaggattctgataaacagtcctcaaattcgaatttaatctcagaattttggcagtgatagaagtctaccaagaaaacttgttagcttgctgaaaaacacaattgagctaaactcaaatgctaaataaatttcagcatgaaaaaatagggatgcttatttaaaaaggaaaata

SEQ ID NO: 138549 - DNA, 1076 bp, Homo sapiens
tagaattaggagaatggtaataatgttcttaacaaaatcatagtagctttctttctgttacctcttgagcaacagcattttctttactcctagaaccacaagccactaaatagtcatactgaacaatcaaaacaggagaaggagaacatggcctgctgtggagaatgaccaattctggccaacctgtggaaatcactggctttgcaatgaaatgagcaccaaaactaattccatattgtttcagggaggcatctgtcacagctacaactccaaaatgtaaccctcatgcataattgaatcttcccttatacatattggagaatcctctggcccagcaacatcccaagagacaaaggctatagttgcaattataaactagataaaagatcagcgaaccagggaactgggattccccgaagcagatctttaaaacactaccacggtaactttctacgtatggatgagggggcagcatgtgggaatactatgtcactaaacatacccctaactaatcctgccactgtttgaagtacagccaggtgggtacaaactggaaacttgcaaatctagccttatgggtctgcaggtcattttcaaaattactagatggtctatgaaaaaaatgctttcgaggtccatcagttgcgataatattcttttaatcaagactacttttgctaagcaaagctaaaaatcaaccccaatggtagtaaattaaatgtaggacttatagataagaggatatggaattaagcagagctgtatctgtgtgtgctgatagaacattaagaccagttcaacggattcatatttcatgctaaaaagaaagccatatttattctgaaccattccatagcaagtgatttttattaatgctattatacaatcttttgtttttaacattgttcagaatgattaaatatcaagattaatgttaagaccctaaaatatatcttgattattctggggttgattatccagtttagggattatgcatccccagctccacctggcctcagccccatcctctttcgtctcttgtccatttctctattttttcactcctctatcagata

SEQ ID NO: 138550 - DNA, 1010 bp, Homo sapiens
gaccagttcctatacctgtctttattttcaaatatcctttgagatgcgtttagaagcagaataccagaaacatgaatcaaaaaggataattgattacaaagtcatcacctgagcatgactaaccttttaacgtactctactataaaacctctgcttcatcatctgtctcagctgaagtttttctttttttctcagttgttactttatgaaaaaggtccccttgaccaaaatacatatgtgttgctcttctttaaaatccctgcagattagtcacctttggcttagatattagttcagtctccatgaaccaattcttggcttttacagagcttaccaaaggactaattagggccaattttgatttatgtaggagacagactacttgtctatcaggaacaaaagcctgccaacttatttcacaaaagccactgaacaacgatctggtaacatttattttaatagctgacacacagctttaaaatacctgatctctctaatagtcaccatgaaattttagtaaaattttaaataaagtatggctaatgaagaggtgctttgaaaaactctgaagccaaacatgtttatatatcttttgcaatgaaggaaattgatcttactctaagattttgcagagaacaagtgacagctcagagtgcaattaaggggaaaaaacccccaattctctgtaatgattaattataatgagcatcccataaaaacttaacatcctaaagcttcccaagaaatgttcaggcagcacaggtgacctttaaataaaaagcgtgctttctatcaaagttagaaaaatgcattccttccatttcttaaaaaagggaataagggagtgaatttacagacaagaaaactaaagttataaaattttctcaaaacctagagatgtgacttagtttactttccaaaggctagtggggacagggtgggcggggggaagaaatcacctcctagcaaacatgcctaatatgaaataatgctgtttgcctaataagaaa

SEQ ID NO: 138551 - DNA, 1031 bp, Homo sapiens
ccagggacagatttttggcatcatacaataactgtgctggccagccccacccagcatgggttgattccatgtacgtattgtgtgctccaatggaacagtctgtcttgggaccacaatgtattgcccaggtgacagctgtatagaaaaagtgagataccagtgatccaggtagccagatataggagaaagtgactaatggtttgtgaaaatgtcattaatcttttgaaatctgatctaaggagttactttagaatacagagaatatttttacttcatgccttcaagtgatcttgtctctaaagcacagaagtaaaagacgcttgattacaatttagaaaatattttgacttctgtcagcaaattgctacattagcttccacaaaatcactggtaacatacttgctatacgaattcttctacaaacaaaaagtttattcatttatatcatcctgaaaatgagcacctatgaggtgacacacatagaatcacccctcaagtcaagctccagtccattgtaatgtctggttttatatcctttcagatttttaaaaaggaaacatggctcccaaacagtttaactctacaagttccaggctatgtcattttggcaggctccaacatgctgcatgagtttttctttctttacaaagcaccatgtctgtcaatcaccctgtcattcagaattaagaaaatgatgtcaactgaagaacacagaacaatggtgatgagtttccgtgttcaaacacaaagcatatcatgtcagatttatctaggggagcaattttcctcatttaacaaccattttagccttgcaggtagacattccaatttatcagctaatgaaatttttcctcaaattattcactcttcatccttctcatacctactaggacaataagtacatcatgatgtgggcaatgatcagttattcttggaagggtggggccactgctctaatttgtccttactgccttttgtggatggctgttatttttaatgactgcccagattccttcagaggctacccataa

SEQ ID NO: 138552 - DNA, 1967 bp, Homo sapiens
tatatatataattttactgccaccagcactagatccagaaatcttcctacaagtttccactagtctagtttttattcttctcaaaagcaaaataaaacattcttagattctacaagtagcagggaaagacatcaggaaatggctgtacaggaaatgtaattgatgattctctctttacaattgaagtggtcacaagattggctagcaaacacaatctattaaatgaaaaaaaaggtgacttctaaaatctttggggaatttgaatacatttgaagcttgttggtacctttgacatcttactgattctttttgaaactcttacctttttcaaacaattgtttgcatttgaaattgggaactttcatatccagtgattgctttaatatttgctttgtttttaacagtgcccttaaagatagccgttttcccccaatgacaagggatgagctgccacggcttttctgctcagtgtctctgctcactaactttgaagatgtctgtgattatttggactgggaggtaagattatagaaaaatttttaaagaaaaatgaaggtaactcttgaggagatgttaaaaattaggcccagaaaataactctttcagcccattctctattgtaatggaggtcgagagtaatatggatgaataaacctcacaactgaacgagatataagtaaatgagttttttaaaggacaaagtgccacgtgttgttataatccccaaactgaatttggttttcatttttctcctactacctcaccaaagcacctcataaaagctgttaataagtaataagaaggactgactggaatttatttctcctcttactttcattctggtgcactctggtataaccgccactaagtaactagttggtcagaggatacatctcagaaacaagaagaaatatttaggataatacaccatttgggggaatcagcttgtgataacaacaaggtattgattaactagagttaaataatgtgaattcattcttggctaccttagtttatacacttaaacactctaacaaataatactaaggttatttctagggtatctctgtgcattgctattgttagagtagcttatattgatcatatttttattcttctttagtacatggggttggctaacattgttagtgaagttcaaaggttctcaccatgatttgctttggtggctgggaggagatgttgagtgtaggtctattgggtctatgaaattttacacacaagcatgcccatattactgaatgcctgttttattccaggcaatgtgctccatgtataaaagtggtaagatttggttcccaccatgaagcatgtcataatttagtggcgagtaaatgtgtatagaaagtatgaagaaataagtgctatgagaatgaaacaatgggaactcagtgataaacataacattctctctcacacatacactcataaatggcattattgtatccttatgacagattttaattcttctgctgttttagaaggaccatcccccatagtaactgaactattctgccttggagacagatcactgtcttcacagtttattagacttgaatttaattttggctttgccctgattccttgtgagactttgaacaatttacttactccactgcaattcagttttccaatatacagaataagacatttataaggttcttcatttgaaaaaaaactctatgatataaattattgttgttataccagagctatttaaaaagttttagggggtggggtgaaaaaaaacttttctacagagagtacaatgctagagtcccctctgggttttgtgctaagattttctggagcattatcagaatatgaacacatcttaggatttttgcaaaggaagaaataaaataaatttatactgttgttcctaccaaagttggaatgtagaaaaccttttgtaaacttgaaatttctgatttattatttgctataag

SEQ ID NO: 138553 - DNA, 1150 bp, Homo sapiens
agtttaaaagattctttcctccaaagataccatatagtgataaaaattaaagtaattccatttaaatgaatgtgaggccaattacagaggccataagaacagacatgcagttatacttaccatagagaaatatgccatttaaaagcacacagatcaaggaatgattcaataaacattgattgattggttaggcagctaggctttggggatgaggtattctacttttcttcctgatcccccttgtgcttgtcaagtttgaaagaaacaggcagtggatcatgttcttttctctgtcactatcacccatccactccacgaaagttagaatagaacattaaaacctgtacagaagggaatgggtcatcttgacccaatagcagagtatgagaacatgaggccgccttgcatactggcttgtcagacttggcctcgccagcactaggtagcagtgaaggcagctgccgtatgcctttgtctttgtggtcctcttctcttcctccacccccattctgttctttcatgtccttcttgtgaccttttactattctttcttccttaccttactagagtagaaaagaggagcgcatacaaaaggtggggaaaaggaagaagagaaaggaaaataaagattaaaaactttacaatgaggtagtggggaaggttgggctcctctctttctctttctccttctcagtatgacggacttgataattttactttgtacctcatctttaagtttgacttcattcttttctttagttacctttagtccccgatcagtgacatatgcagaaaattataaacaggccgcatgataggaaccagtatcctgcctctcagcagacttgtatcatctaggactggcagtagttttagaaaggacagctgaaccagcctgacatgacacataagttagagtgacaacacatgttttgcagtttatagagttcaattaatagatttgattgccatggaaagagggaaggaaaagaattgcatgactcgtgtactgagtatgagagagcttattcatacaggttggaaaagcaaaattaaaaaatcagaaacaggcccaccagcctagatatgtccaaaactagtactttggtaacctattatgacttccagcagattaagtttcaaactgtgg

SEQ ID NO: 138554 - DNA, 1042 bp, Homo sapiens
ttttcacatctttgcatcccctaagtagctatgagggattaggcatagagcaaaataaatgtttgaataggagagtcatttcccctagtatactgaggtatttgtttactagctgggtaagataattaaagaaagtgttaggagccacagcctatgcaaaggaagtgagaaatgaagattaaagcatctctgaaagtataagtcataggaaaataaaattaatttgcaaaggtgatttacttttatttttaggaatggtgagatgtatctgcattttgttttctatttatagttttaaatcaaggaaatttttactcacttgttttataactggatcagttttcatttaataaaggataggaacactcaattcttatgggatatttagatattctaatcacacctattaagttgtgctattataaaaatgaaacagttgaaatacaagtttaagatgtgctcccatggaagaatctatatgtactaattgtacaaatgagatgagaaacagaaatagcctggggaaaagaaatggggatgctatttaacatcctatatattacttctagcagacaattgcaatttacaatcactttataagaagaggtgccatgagggctgcttattaaaattgttttatgaaggacattttattcacagtagcactactgtccatatattatttttaaatccctacgagagagatggtcatttttgtgaagtttcggttgtagttcctggtcctacaaaggtttagtgagtgagtgatggcttgtcagaaatgatctttctgtgatggctgaaaactttgggaggaccaaagtttcaggtgagcaatcctaggtcatagcttcacatcctgccatttattatctagttaattatgcttgattctgcttgatacaaaaataaaatttgcattcaacaaacaaaacagtacctcacctctttttcacaaagaagaagatttgggctagagattgggagattttgtatttagcaaatttttaaaagtccttttgagatgtgtcttctaagggct

SEQ ID NO: 138555 - DNA, 1002 bp, Homo sapiens
ttgtacagtcataattcattaaaatgacttcattttaacatgtaccgatgtagactaatattgtaagttctgatttaaagaatggtgacaaaatggcgcatgtaatacttttgcaagtgttggggaggtcggtatgttttgaaaagagtaatttaacttttgggtgctaggaaatgggttatctcaaagaccattgctggcaatgggcaggcctggtaatactggcacagagcattaatcatacaccttattaacggtgaggtgaataactttgaaataaagttttagggaagaaaagagactacccaaaacttagctatctcatgaacagttgatactaattataataataattgctttgaatctaaaagaaaaaagaatatttttagatgttaatttttcttcacaaactctttgaagagtgtcaatgtgacattagagaaaaggtctttggagtggcagtagaactgacaacacaggttggacttcagcaggcctgaaaatggtatggccaaaaggggagatttctttctgcctctaataaagagtagtggctaggaataggagtcatctcagatgatactggatttcagctgaagcaactcttaaatatttcagtggtaaaaggatgactatgttaaattcatgggtttgtaaatacatgttataaaatgtaattgttctttttaaaagcacatatttttttaaaagcctacattttaaagttgtcatctattgtgtattgagatgttcctgtgcctcacagatcagctcactaaggtgtggtagctattgtctaaaaatatgtaccctctcatactgttgcagcttcctcttcataggctttattattgcccagagcagcacatttaccccattagccaaaatggcacaaacaacgcccattggcatgactgaactctccttagttggtgtcaatccttatatctgagataagaagctttcctgtgtctacctttctcacctagagtaaaagccaaa

SEQ ID NO: 138556 - DNA, 1026 bp, Homo sapiens
tacacagggagtttaccaaacattagctagaaccaagttggattatagctctgatgcttggcaaatgaagaaaattaaaagttatagtttagatttcactttcctcttgtcttgttaaagtgaattcatattttgttttagtacagtaaactgatatctgtctcctttcctgagagtcattgtctgcgatagtcttcattttttcagatgaatgactgaaatggtaaagctaagttagaacacaaatattgtatgaaattattacattggatgtggcctaaaattatactatagacattaaaaatatatttcttttgtctgaatatttacataataaatgttgggcttacttataagtgtctaaagtatttgagtcattaggacctgaatgaacaggaggacagatttgtatcttagtgttctggaagaataagatggttatgctttgatgtaactaaaggtgattatcatgcaaatcctatgcttttaccacttttaaggggacaatgttaggaatttgagtactttaaaataattgaaagttgaggttttggtgtagcaattgaatattaaaattttagttatgatcttatgagcatgagaaatactttttaaaagtagaaggcaaaagaaatgaagcccttctctgtgatctttcccattctctcaaacttcaaactgccttaaatgtggttatccaaagtagtagtccttggaaaaaacttacttttcatcattgataacaatttgttgatctttaaatgctaaacacttattgcatcgtaagtcctttatcttgcatcataaatatatttttcttagaaacaactctagtttttcttacattctctctcaatttttaaataaagagcaaactttcaacataaaagtcctgtcctaaagaactacattatctgatctacttcttgttaacaaaagaaataaatatatctatatttatataacaaaatagacatggacaaattgtaacatttaaaaaattttctattggaatagaatatcata

SEQ ID NO: 138557 - DNA, 1075 bp, Homo sapiens
gtacatattaaattacacatttaatactaatcaatggcaatttattgtacatttcccaaaataagttgttatgaggaacactggttcctttgcgctacctgaagaaaagaattctgtgaccaaataagtttgggaaacactggttaaaaaatgtaaacaactctgctcactgtaggacttctcagaaccttttatgttaatagtgttatgtatatctaagagagagaaatagaatgtagcattttccaggcttatttgactacaggacccttttatcctcccaccccaaagtctgagtgttccaaggaaaacatttttggaaacacaagtctgttttcaaaacagaatattactttatatttgggtagtaagagttggtattatagaaaccctttgtgctttctagtgaaattgtagcagaaatcccattatcaaacattatataccttagaaatctttcgtagtggtcattgtggtagcaattgggttttgtttaaagaaaaaaataaattcttttgccaatgttggcaaggggtgaaaacatccaacttttctggacttgtccatttatatcctagggtaatgaccagaagaattacagtataattttctgacaataatgtgattctgaatgaattgttcaaatacttgaagttggaaatttgcctacatttgtataccttgttaccctcattgcaatctatagctcttcctgtttacttttcatcttttttctcatgtttctatacagcttcctcaaattgtatatatcacattaaagaggcgtgtgtgtgtgcgtgtgtatacatatgtttgtgtgtgtatacacacatgcacatacctggttttacttctcatttttgtttggcttaatttcttttgtataacaagatattaacaatcatactatttggaaaagatgaacaaaagaaaacaagtcttacaaaatacaattaatcttttttcctggattcattttagcatcaaaagttgtaaggagtcatttttaaaagttggaatataatatttttctgttcagtagtgtgcttatcatttttacgtattatgttattat

SEQ ID NO: 138558 - DNA, 1063 bp, Homo sapiens
cattggtttttatcccggattttccaaattagacttacaaataagtcagtaatttgaggtttaaatgagtaattacacagttagccataatggttaaggctctatagttaagattgcccaggtttgagtgcctgcttcattatgtatcaactgtgagactccctcatctgtaaataggaatgttagtatcagcctcctagaattgttgatgaagactaacataattagtttgtttaaaacatttattgagatagcaaacatataggatacactcaatataatgtagtagtagtataatataacttttgctaaatgtagtcctattgggctggcctgtgagccccttgaaggcctgtcttttggtctttatatctcaggcacctaacctagcagacagtcaatactcaataaatacttgcttgaattgaattgatttatttaccctatttttatcttccattacagcccactgtttgtaacatggaagattggtcgagacaaaagattacgtggatgcataggtactttttctgccatgaatttgcattcaggactcagggagtacacacttaccaggtgaagaccaatttttgttacctctgcttttacattaaaaaaaaaaacttatgaaacttgaatctgatactttaactccttttactgaattgtcaacgttcttgtcttccttcatgtcaggtttttcctttgtctttaaccatttaccttttctctggtaaaatgttattgatatatattaccataatataaaatactgtgattaatgtattctgccatcgatgttttgaagtgttttttttttcttccagtggccagcttattttgtataacttgaaaaccaatgaccaaatgtccacgggttaccaaaatatgtgatttctatagtaacagtcattatttcttccctcttgtgttttttaaaaatagttgttgtctctttcatcttacacattttgttacacttttaaggacttttgaaattgaaaggagagcctaggaagaaagtgatgccacagcctagcagtataatcattcacattcacac

SEQ ID NO: 138559 - DNA, 1033 bp, Homo sapiens
tccctctgtgttgcgtgaagaaaaaaatttgttcctatttttagataatatgtgttgaatgttctcgtagtcattgccctgtacaacgtggttatcacacacaagatacaatgtcttgtgctcagggatgtttattacgtttctgtctactttaaaatgcttaacttcccggattcttatccccattaaatgttgcttttaggtattttagttgtttttaattccatacacgtgtactttataaaatatgttggatgagcatttgtaatgagaaattagagtcccagatttttaatgaatagttttgttctgtctactaaaagtctgacttcttccatcttcaggcatctgtcctaaacacagtgaggttgtggagtagcactccctcccatctttgacacagatacttccccgcaatcccaactcccaaagtggatgttgcctggggtaggtaaggatcagggagagtatagatcattctgtatctgctctacgtcttatgaaggctcttgagaacacatagtccacagtgcttcaaattcaaagaaatgttaaatctgaaagagcccatagcaagttatcaagactatcagactacttcctgtttcctgaatgtgctgtgcacttttacatgtccatgcccttgcttgttttggagcatctttgctcctcaggctgccttgtaaaatgcagcttgtcctccagcaacttaagctctgaattaatcattctgtcatcagtgatagcatggcattataagaaactattaatatataatttctcccatcttatgtttgagtgccctacaacgtatttcatagtatagtgtttagtttgtgttatttttctactttaagttttaaatgtttacttgagcagatagggttatattatagtaagaatggtgtatgtatatatttcctgggataaataagaaagtagaaggtaaaacacttaaatgactttcatttctagcgtttttgataggaaatgaattcactcacacttttaggtttctcatggaagtcattga

SEQ ID NO: 138560 - DNA, 1051 bp, Homo sapiens
aggaggaaagctactcagagacatagctccagaaatctgcatagatgttccccttatctctggctgaatatgaatctgtgcatgtatcaagggcaacactgtgaggctgggcagaaaacaactgctcaggagctataagctgaaaacttaccagagctcatacagacctgagagatatatgagttcctacagcaagagttgtgagcccttgttgaacacccagggcattccagagagactccagaagggtcatactttagtagtaaaggctacattaaagtaaaggactttaaataattatccacaaataatttaactgcatgacaaaatgaacttcaacagtctttgaagagaggacagcaaattccaaacactcaacaatataatgattataatatctggcatacaaaaaattactagacatttcaagagggaatacaatgtgacccataaccagaaggaagccaatccgtagaaacagaaccagaaatgatggttatagaattagcagacaaggactttaaaacagctattaaaatgtgttgaaggattgaaaggaaaacatgaatatagtgagtaaagaagtgaaagacatataaagaaccaaatggaacttctggagctgaaaagtatactataaaaaatgaaaaattcattgaagaaataaatagcaaattagatgctgcagaggaaaatatcaatgaatttgtatccataacaatagaaattatccaatctgaaacagaatagaaaaaatggaaggaaaaaagcctcagtgaactgtgagacaatatcaagcagattaacctacttgcaactggagtcccataaggaaaggagagagagaaataggcagaaaaaaaattgaagaaataatggctagaaattttccaaatatgatgaaaatgtaaatccataaatctaagaagctcaatgtatccaaaacagaaaaaccacactaaagcaattataattttttaattatttatttatttatttatttttgagacggagtttcactcttgttgcccaggctggaatgcaatggcac

SEQ ID NO: 138561 - DNA, 1543 bp, Homo sapiens
atttaatgccaagaaggagtgtgagaagtagtccctgtgggaaattgtgttttctttggtctttggttctacagctatgtagaaattctggattgagtatgaagtttatttatacatgtacatgtacatttatctgtgggatttatctaagaagcagtggtttggggtattgttcttgctggtgaaagaagtggactgggtggaactctagagaaaaatttgcttttagggataaacatgttcaatagctcaggtggcaaattttgctttcttgtattgatgtgataagctgagtgggtcactgccatttccagaccatatacaccacctttggctgatttgtcttctgtcatgtacctagcagttcagctggaggctttttaaaccaaagtatttaaatatacataggaagttgttgtactggtgcttattggtggctactgtgttctttcttatcttcctagggagtgtggtccttttgtttagcttctgtttcatttgtttacaaagttataggctttgaagtaggcagttatatataggattgcctaaagagacgtggaaagtgagaagtctgctttataagtaagcaattatccttatttcactgccttattacctcagtttctcagccagtgtctttcatgaatttggcttttctcataggcttgacattggcttacttactgctatcctaatttttttgtggaaacttacttagttttgtgtctcccagattagatactagctcagtttactttctgaacatttaactatcaaagctttgcctgatgtgttagtgaggaatttttaaaaaataatttttgataatttaatgatacacatcacattattttttctatttgttccatcataaaagaaattttcatatctggtttccttaatgtagggttcctggccttaggtgactgtccttctatagatatggcattgttattacaagatttgtactggtaagactatgataaatttagtgttttctaggacagtagtgaggtaaatagctgtgctgtaagattgtttaaatcatcatagctgaaaaaataggcctttaaaaatagcgataacagaatacacatacattagacataatgcatgactattaatgacttcctcaagatcttttaggagttatgaataaggtcattcagattgcactttttttaaactcatggagagagtataagaggagtgagctatttttggcatgggcttaaagaaggaaatatcagtgtgactggtaactgacatgtttgtcaagttcagtttctacctgagtgctttaatttcttttaaatttcattactttggactttagagttctcagtatgaaattttttaagagtgacttgtctaacctttgggttctgagtagtgtgttgcccctgaaattggttgagtcattttatattcttctaagagttcaccacctgtcaaagctgaagagatctgtcccttttgccctttatttcctgaaccatttttctttttttattattattatactttaagttctagggta

SEQ ID NO: 138562 - DNA, 1548 bp, Homo sapiens
aaaaatgataatctcagagtatccctacttcttcaaggtatccaagaaaggaaattaacaattttgggcgtctacctagtagaggtctcattgacccaaaatgatgatagcattaataattatacctttattgacagaattataatacttagcagtttccaggaactttttaatggatagcgtccttggattcctgtagcagttcatcaagtaggcagtccccatcttgcatatctgtgtccaaggatgaagggaataggatgattccttcatggtcttttgactgatggatagtggagctgagctttgggcctaagtcttctgacacccctcctttccctgccctattccagcacttttatccaactatgccacatttttttttttaatctgaggttctggtacatgatttctcaaattactagaattctaagacaaaatgtttcttaggtttcacctcattttatctctgagatgtttatgttcctaagagatagttcttacgtgtgggagttttaaactctacctagaggtcagagaaagctgtttatgcctttgatgtaaattttgtgcaccatacttagactatactacacattccaaaacagtatttcttgggcctagacttgtaacaaaactctctagtgtgatgtattctcattcactcttttatattaacctattttattctttcagcaaacatatttagcccttactatgtgtcaggggataggaataggaccgtgcaaaaagacaacctctgttttcttggagcttacgctgtagtggataggaaataagcaaatgggtagtgatgtgtactgtgaagaaaaataaagcacttttaaattttcgcccaagccatgagattactaaattgtggtatctatcagtgaccccttgtagaccttatagaccttctaaaaagttagttattgagaagatggcccaggaaaggaacattgtctctgacatccctgtgcagtttctaccttcttttccattatttgaactaagatcttgctttcttgtatggttgtgagcaaccctgatcgagtggagtgtaagggcatggccaaacaaagacagattggagaggaagcctgttaggaataaagcaccttcggagaaacagtctcacaacaaatactgttagagttgtatttgtcatttatcctttaaatgtaatgtgttgccttatagagtgtcacatcaagaacactgaaaagagatgtatttcaaaatatgtatttagctatacaatggttaacaaaacacagcataaaaagcagcctccttaaatgcttctagttttatggtgtactactgtagaatgagttctttttgactgaagtgttttaaaagttttgaagaaccagggagtctgcaagttggaaagaagccattcttaccatgaggcaaatatacttgagtttaatttttaaactataactgctgtttgaccttaaattaagacagtctgttttcattgtggtgttttactggtttaacaatgagaacatttaaagcagctgccaccaattaaaa

SEQ ID NO: 138563 - DNA, 1298 bp, Homo sapiens
gaactatcatgatttcttgccttcagagttttagttctgaagtttgatgccttactctttttttcccccctctggttctgtcctaccatgacttaaccagcttttcctttgaatccctcctgcctctggagccatttccttgctgtctagtttcattttattttttatttttatttttatttttgagacagagtctcactctgtcacccaggctggagtgcagtggcaagatctcagctcaccgcaaccgccgcctcctgggttcatgcgattgattctcctgcctcagcctcctgagtagctgggattacaggcctgtgccaccacgcccagctaatttttgtatttttagtagagatggggtttcaccatgttggtcaggctggtctcaaactcctgacttcaagtgatccaccctcctcggcctcccaaagtattgggattacaggtgtgagccactgcacccagcctcattttattttaattaaatattttctctggtattctgttcctttggaggaaaagagacccttaccaggtgctacggtatgaatatttgtgacctcccaccagatttatatgttgaattctaatctccaagatgatgctattaggaggtggggttatttgggaggtgattagatcacaaaggtggggccctcatgaatgggattggtgcccttttataaaagaggcccaagggagctcattcatccttcccactgtgtgagacacagcaagatgttgttgtttatgaggaatgggcccgcatcagacactgagtctgctggctccttaatcttggacttcctggcctccagaactatgagaaataaatttgttatttgtgagctacccattttatggtattgtaaatagtccaaacagactaagacaacagatatttctctaggtattttcaggcagagcatttcacttggcctaggtgtatgtatttttggatagcagacttccttagtcttctctcaataaattcctgaaccagagaaggggaatatgagtaattgacttttctggttgccaaagatgtctttagtttacatgaaaaatgttttgaacagttatccagtgcatgcttaaatgggctgtctcttataacacatctgcacatacaggccagatttaactaccttacccagattgaaaatttccttttccttgtggactcagaagtttcttcctgctagtctggttcctgatggtatacagtggataaacattttttttttgttaacccatatatcaaccataagaatgactgaaataaaaaaggaaat

SEQ ID NO: 138564 - DNA, 1073 bp, Homo sapiens
aagaatgctgtaacatgcaggatgttttcttgagcgttttcatgattaaagattaatttcttcctgaatttggcttgatagatttgtattgaagagcactgtcaactaccatttgagtgccatctgtgtatttgacagtatactgtggactaataggaatttaacgaataaaatagtgcatttttggtttggcaggatttcttacagagataaataggctgggcacatttgccttgtaggtatgtgtgtttatgtacatatatgtttcatatcaacgttggcctgtaaacttccagtataaatagaataatttaccaacttgttcttccactgggacataatgtaagtaaactatcttttctagctaactaagcaggtggctatttctatgactagtatgtttcaaattttaatatacattgatgtaattaaattttgtgtgtgtctatgagtataatcatctctcattatctctgcttctgtgggggatcctaatgtaaatagtgtaaaatagtaatatccttgcctccttttcttgactttttccctcattctgtgaactggctttatgtgccttctgtaccttgctccagtgccttaagtggtcagaagtgggtgactaaaagaggtagaaattgccacatgtggataatggggagttgggtatttatgataatacatgggaatgagggagacatattaataattttgaagttaatggacttatttgttgagggaaggattcatggacagttttgaattatgtttcaaatatggatttagaattttatttagggggagaggactagacattctagtcagtgaggatcataaacagagctgagtaagtagttttgtttagagagctgttgggaaataagtatatttgagaattcttgaatcaagagagagaagagtggagtggcttaaaattaaagcatctgtttattcattttgacttgattttctaacctatgtgggaatgctgtagaagttatatggttgaataagtgagggattagacacatttaaatcagagtcattattgaagaaaatatcagaatagtttagtc

SEQ ID NO: 138565 - DNA, 1425 bp, Homo sapiens
tgtgtagactttttagattgacttcttttacttggcaatatgcatttaagtttcttctccatcttttcatggcttgatatttcatttctttttagtgctgagtaatattccattgtctagatgtactatagtttgtttattcattcacctactgaaggatatgttggttgtttccaggttttagcaatcacaagtaaagttgttataaacaccatttttctgtgggttttgtgtggacataaggtttcagctcctttgggtaaatacgaaggagcatgattgctggagtgtatggtaaaagtatgtttagttttgtaagaaactctcaaactgtcttccaaagtggttgtaccattttgcattcccaccagcaataaacaagagctgctattgctgcacatccttggagatacttctgtatcagcacacctgcaacttcctggttcttttctttttaaaaactatttattttgaaataattacaggctcacaagaagttacaaaaatagtgcagcaaaatcctgtgtacccatcactcagcttcccactggtgatatataattatagtgtattatcaatactaaaaaattgattgtcacaatgtaatcaactagacagcagtacctgtttctttttaatgcctacaagacattccattctatgggtgttttatttaaccagtcctttattgctgggcattaaaattgtagtattgctggtatagggaaagataggagaaaataaagtctgtgtattcggggccactgctggcatttacattgcttttatgtgaattagaaaagagttccctctctgggtggatgtagtcccataggcacatggcttgggaaactagaatataacctagataaatgtttttagcacctctgcatatatatctctttgaacttaagtgggaatacatatgcaggataatggactgtcatttaaattctgcaatataacatcagtgttccaatgtgaaacttcgaagctgtccctttcagatttagcatgtgctcccatcctcctacctgtaaccgtcatcacctctcccaagtaccttaggtcttgtatattttgtgttattattattattaagacagagtctcactctgtcgcccaggctggagtgcaatggcacgatctctgctcactgcgacctctgccttccagtttcaagtgattctcctgcctcagcctcctgagtagctaggactacaggtgcgcaccaccacgccggctaattttttaaaatacttttactagagatggggtttcaccatgttggccaggctggtcttgaactcctgaccccaagtgatctgcccacctcagcctccccatgtgttgggattaccagcatgagccaccacgcccggcttgtattttctattatttatgtacatgtctaccttacattgg

SEQ ID NO: 138566 - DNA, 1037 bp, Homo sapiens
gtggtgatgggtgtgataatttgattgtgataatacacagtgtgtatacatataacaaattatgttgtacaccttgatctataaaatctttacttttcaattaaatatttttaaaagggaatacctttcttgttttgaaaatgcttgatgtgtcttttctcacattaatgtaatttagaggaagagaaacagatttgaagaagcctgagccaagggattataagttatccttgaaagcacaaatactatttatcatgcagtttccctcatgaaatgttttacggcagacctgtttatctcatagatctgagtcaaagctgaatttaacacgttaaactttaacttatccagaattagtatcttttgtctaagaaccaacactaaaatatttccttatgttaatcaccaacactagaaatttgcttaattttttttcaaaaacaaaattttgtatcactttttgagttactgcatagtttataatgcaaagaaaacatccaagcttagtgaaatgataggataattactaacttagcaattcattcacacatattaactttaaagtacacaagattcaaattcttcaaattaatttctcaattaaatgaaatacaatgaaatgtaaataaaataattaaatgaaaattaattaaggaccttaatggttgcttataaattcctgaaattgcggattgtatgtccatggagtctgaagatccatagtaattaaaacgtattgtgttatatatgtttatagtatgctcatgctgttttttaaaatatgtatagaacattgaactccacataattgatagcatcataaatatcattgagactactgttgttgattttcatgagtgatttcctctatattatctgctctgtttaagttgattttccaagaagaggtcttaatgactttgtaatcactcttacagtgttttattcattgtgattgactatcagtatttttcctcttgcagcctgactcctaaacccagagtctcatatacaattgtaggtgctacgttaagaga

SEQ ID NO: 138567 - DNA, 1003 bp, Homo sapiens
tgtttaaaatgtctagttttcaaccaaaaaaattaaaatacaaccaacagtaaactatggcacttaattcagggacgtaagcaatcaataagaactgtcactgaggaagcctagatgtgcttactagatgaaactttaaatcagttgttgtaaacctcttcaaagaactgaaggaaatcatggctaaataaaagaaagtatgagaatattagacatattaggaaagaaagaagcatttatctaaacatattggaaactatagctatgtggtggtgtgctagaggataaatgaagccacagggtaaacatgatgtctcttcttcgaatgtcagttttccagaattaaaactgagagcataaatttgatattgaaacaaatataggtatgttatagtgtagaatgtaaaattcacaaaaataaagcattatgaaatttgccatttgtgatgggccacttacggcaactctcaattcctactcatttcacacctttaatttattttgcctatgatgtacgtcagttgaaaagtttgagaagtctaatctaatgatctgttgcttcagtgattgtggaccaatgacaatcctatgttagaaacaaatgggcatgtcacagataagagataactgtaatagaaaaccgatttccacagtatactcactaattgaccattgtgttattttcacacttggaatatcctacctttgatgaacaaaaggaatacctttacacctgaattgacatttctccaaaaaagacatgcagatagctaataggtacaggaaaaggtgctcaacatcactaatcatcagggaaatgcaagtcaaaaccacaataagctatcacctcacacctgttaaggatggctgttatcaaaaagacaagagaacacaggtgttggcaaggatatggacaaaagggaacctttgtacactgttggttggaatgtaaattggcatagccattatggaaaacagtatagaggttcctcagaaaattgga

SEQ ID NO: 138568 - DNA, 1055 bp, Homo sapiens
tgaggctctctatcattagctggggtgtagacgttttaaaaataatatcactgaattgtaatgcatcaatttgggttttggagcagtatctaacttgttccatttagaggtggctttgcagttctaaacaagaaagtagaatttttactatgattatccctttgcttacaggcttttaaaatgaatatttgttgaagtctcaagtcttttttgccagtattatcttaagactgtgtttgacatcaatacctatctcttattctatgcaagtactgctcttaatattatgactggttctaatatttcatttcaacaagtaatacagctgttctgggtagaacactatgctagacccctttatgagtatgggtgagaaatctataaaataggcataaaccatgcttcatgtccttaaaaagcttgcagtcatactgaaaagacaagattcatgaaacaaataatgaagtcacatatgattcaacagctaaatgagtgatggagacagtgatgtctgtaggactcattgtttgggtagactaatgtgggctaagattgtacaggagagctttacagacaaaataggatttaggctaggtagaactttcatagatggaaaaagcagtctaggcagagaaacatcttagacataggtcaggatgagcattatacagtggtcagtgggtaccaatcaaaagtaggttgaagtgggggagaacctagcaagaaaggggacctgtaaggagactagctataacaagcattgggaaatgaaggtctaacagttgacaattttaaaattttaatggcctgtgagtggcctctttcttggtaaaatttctctttgtctgtttaattatgtctcaccagcacctttaatgttgtgaatgtcatgaaaccttgacaagagactaggaaataacacaagcagtagtctgctctgtagacaaagtgctttcattcttcagtacgcattcagcttaagtcagttagattaacattggttatgtcacactgcctgagtgccttctatgttcagtgatcttttttcttctgaa

SEQ ID NO: 138569 - DNA, 1047 bp, Homo sapiens
gtcccagctacttgggaggctgaggcaggaggattgcttgaacccaggaggtcgagggtgcagtgagccgtgatcacaccactgcactccagcttgggcgacagagtcagaccatgtctcaaaaaaaaaaaaaaaaaaaaaaagaaaaaaaaaagtttctagcagaagcaaatgcatatcatgaagtttcataatatgaggacctgctatgggtccttttaatacttataagagaccatattgaaaaccatttgtacagtgtcttcagaatgaggcctctacataactctggaagctatgggacaagtagctttacccaaaacagcataaatgtagccactctcctgtaattatccttacttatttttcttgacttgtctatgcacatagctataaatcctcaggtattcagacatatcttctttttaggcctgtatatttatattaatagcctctacttagatgtgtgaagtttgtttcatgtagtttgctcacagttattatctataacaaagattatggaacaggcactattaaatgatagacccaggtataatttctgactggctgcagaatacagtcatacaaaggtacatacctatctcttttgtactttatcttagaaggacctactatggtcaatttaatttgtaaattacattctcacagataactggagtgtcagccattttttgtttatcagtttatcttttatcatatacatgtaggctgatggtagtttactttttttttttttttttggagacagaatcttgctccatcacccaggctagagtgcaatggtatgatttcggctcactgcaacctccgcctcccgggttcaagtgatttctcccgcctcagcctcccaagtagctggaattacaggcacctgccatcatgcccagctaatttttgtatttttgtatttttgtagagacggggtttcaccatgtttgccaggctggtcttgaacacctgacctcaggtgatctgcccgcctctgcctactgaagtgctgggcttacaagtgtgagccaccgtgcc

SEQ ID NO: 138570 - DNA, 1093 bp, Homo sapiens
tatcatagtacagccttgagcaagataaagcctcgtggcaggccatctcaggaattcataatttcagaactaaagggaaatttttgaaggactagaagtgcctttggtacaagattctaggttgtgtgtcctaaagcttagaaagtaaaatagattgaatcaagctggatctgttttgtggctttgctcaatgatgaaggatggatgttatgaactgatgggatcagccatattgctttaggatctttgcgatcttcagtggatgggcaaaagtgaaaagttctgcttgagtaaagacctactaatactagtttttttcaataaagtctgtgatagtcttgatgattcttgccttttccctatctgtttcattttacagataatccacattgttacccaaagccacatgcagtgccgggagagcacagttgactgttttatgcagtatcctgccagaagatgctgaccagttctctagtaatagaaagtagtgagattgaattaagagcctatatagttcaccttgccattcgatatactttcactgtgatctgtaagcatattacatacaactttagtaacatattttctagtgagatcttggattgctgcaaggtggtaacagattctctgctttgcttcaggtgttagtggatctttgagtaattcctatggaatggagtctctgaaaaattggttttgatgctgttagcctaggggtcccacagcactgtatctgcctcaaataaatgcttatgtactagttacattagtgtgtttcttttctgtgatatcattatcgcttatagtagcctagcaaccacacggttaggtttaggtggtttggggtgcaaataaattatatagctggtaaaacttgggcctcagtacataattcattgtagcaaggcaaacactttgtgctgattttgaacaaaagtgaagtgtttagattgacgggtgcttttttacctccttttttatatggtaagtagaagatggcattggtgatttattcaataaagaagaatctcatgaagtctttgccttttttccatgttagagtaggtattctcaacacaattcatgtgtt

SEQ ID NO: 138571 - DNA, 1339 bp, Homo sapiens
gttgggtggagcatgttttatgttcagtccaactataagtggcatcttttgtatcaagtgtgggtgtattttctacagctcttaatgtttcagacattgaaacttgctcaaagttaaaaatgttagtgttgaatagctgagtggaaattatatgtcattggaaaaaaaaaccctgtttttgtaaaaaatatacattatcctgagtttcatggttggaaaccagaaaaatagaaggaatagtcctatcctcacagagcttacagtcctgttcaagatatgatactattatcaaagttgcttgaaatacttacaaagcaatatatacatgattgtagattaataaaatacacataaaatgcatacacatggaaatgacatggaataaaggagtggtcagggagaaggctatagggagggaataactggaaccaagttttgaaatggaggaggtacagaaattattggtagagtctgtttgaccagtagatcttgaagtcttacttggttgttcttaaacccgttgctgtcaccaccacaccccttgccacagtacttggggattcccagcagctgtcttcagtcagcaacttgcactctcagcattcttcatatcactccccttgctctggtctctaagatcataaaacttcaaggaaattaaaagtggcctttgtgttgagaatcctctggggaggctggataagagatcttgtatctgcttatagtttcttgtattaggaagagaacaggatttgcagaagagtcctctagagtatcagatgaattgggagaagagtctcaagataggggagactaactaggcttaaggttatgagggcagtaggaaaactggcattggaaagtgggaaagccaccccaggggcagagtttgtgaatataggaatgttgcaaaattgagaattggaagaagttatcagcatatgcaagggttcatactctagggccaggttttgtgtaggagtggaaagattgtagctcacctgtttttggcttccatcattgcctcttcttttcttggctctgtgcctagctattcttgtgctcagaaaaagtttgttaaacagctctgttgaaatggctatgaaatttgatcacaggcataagaactctcctcccctttccctcttcacctattcccagctgtatctaatttgggagaaaggatgagaggacacatcggtttatagaatttgtatcaaatataaagatagctggaatagcttttggatgaggacctgtgattaggtgactacatgtgcatggagaggcactgcaggaaaaaaaaaaacaaattctggttgcttggcagaagtaaaag

SEQ ID NO: 138572 - DNA, 1027 bp, Homo sapiens
cagtgtgcttgggaggaattgggttgtgttggggagtaggcattttgtttcaacagaactgtggcaatcctattgcattatcaaaaagatgatttgatagtgctgctcaggttaaaatgatattaaatttgtattttaaatataagccattatatttctgttatatgttttctgatgaagattgaccagaatagccagaagatgtatctgtctatcgcagatgatgccatgaggccatgacagatttccttatccacactaacataacggtactaacttgcattctctggtcataatgtatagtttttcttataaaagcaaaacactgtctgaacaattgagtcattttgaaggtataatatggttgtttttttttaacaatgttgattcccattggaagacaatctgatgtcgtatcttatggatagaaaagaaggcaggcatgtccccagttgtcagttgttctgtaaaagccatcagtgactgagctagaaggatggagaaatataaatcacaaaattgtttttatatccatgcataaaggtgtatgtgggacaaggtatatttagttaaaaagaaaatgcttattttgctttctcccccatatggccaaagggagtgataatttagcccataatttttcttgcttatgaattatgtttgtgctatactcaggtttcagttagcgggtggcagccaagtaggaatctctgctgaaatctctcagtccaatgggaagaaagaccactactgaaaaagtaaaaaatggtctgttaacccatgcatgagttgtttttctaagtatgtatttctcaggcacatgctaacatgtgtgttgttgtctttttaaaaactgtatgctttttgaaaccaaatttgtgttataaatactaaaaccttagctgtagtggattatatttttgaagtgaattgcatttcctatttatagacagttttactttttgagaatttatgtgtgaaacactaaaacttgtgtaatgagattagtcagttcccaagttttcct

SEQ ID NO: 138573 - DNA, 1050 bp, Homo sapiens
ctaatttaattggacttgaatggggtcttggatggggcctgggaatcaggattagtaaaagctcaccaggtgagtttaatgtgcagccaaggtggcgaaccactggttatagtctactgaatctttctcttgagatttggataatttgggctagggtagtgccttggaatctgaattttatgagcaccctaaatttcagtaaacaaccgatttgagaaactcttgcattgtggtctgcagaagacatcacctgggaaatcattacaaatataggctctcaggccccgcctcagacctgctgaattagagtctgcagtttaacaagctcctcaggtgattcttacgcacattaaagtttgagaaggactggttctcatactttggagtacatcataatctatagtgcttgttaaaacacaaattgttgggccccattcccggagtttctgattcagttggtgtggggtgggactgtgaatttgcatttctaacaagttccctggtgatgctgatgctacagttcccagggccacacgttgagaacctctggagagagaattgaggacctgaataagtacttgagcgactgtaatggaatggcaattttcaaggccagttttcagtataaaacttcctgcttctgtgtcactatgctttagcatgttcattctaacctagcacccaggagattgagtgctgccgagagtataagagtctgaggttcttgggatggttttagttgaggggtgagggtgactcttggaaacctgtggtatgattttaggtcctttttcagaaattgttaaatgtaagggatacattttaggagttaaaagcattacaaatatgataccttaaggtgaattatattgattttaataagtaaagccccctttgttcccataaaatgctcttatgattctttcactaaagtattgtgaaaagattttaaaagcttttacttatgcctatggttgctggatttcattttaagactttccctctgtaacaaaaatatgaaaggattctgctaaggcactgggattgttc

SEQ ID NO: 138574 - DNA, 1093 bp, Homo sapiens
tcttggatgtctgtgatgtattaaagctagtcctgggatgatacttaggttggctctgcaaagtcatgggactgcaaaaattcactcctgtttagttcttgagctgttaacatgagtttggcaaaggctgctttagtattcacgctccattgctccaaagcatatgagaacacactttcaggaggtgctattttcacacattttacagtgagtttgggttaactcaatgactataacaagaattttaaaaggaaagtgagcttgaccagttcatacagaaaatgcttttgaaaatatcattttaacagtagccactttgcacacgtatttagatattattctattcaaacaccccagcccctggatttctttttcatggaattaagcagatgataggacacactttgaccactgtggatatgttgaaacggtggtggaagaataataactattatcatctagcagaccttgaatgtgtcatgtattctataaaacaactaatgtagagtagacactaaacatgaccaagtggagaatgaaagttcacttaagtggaaaatggactgtcttatttccatttatcttcaactcatttttgaggtgtactgtggaaaattcaggaaaacttcctgattatgggagggacataactaagcatttcaacagtgccttagtaactaccacacatttgtctttctgttttacatatttaacagcattgtgtacttattagtgttgctttatcctaagtgccataagacataaacagacatattgggatttttttttctcatagttattatcatgtcatgagcagtgtgtttcaggtcatgtctctgcccaccagatgttgtgcttttgacagttttaacttctcatacgtaaacgcacactcttttcatcctttcccaggacttttctctcagaatgtctgtaactggtgaaatcctcgttttatgggtttagaagctgtagatccatcagttagttatccttccactcagtattgaggggatgtcaatatatgaacaagctgtatggatacaaattcttcactgttgcccccatgttttgattacctacccaattgcag

SEQ ID NO: 138575 - DNA, 1501 bp, Homo sapiens
ttcctaattaaagcaattactttccaccacccctccaacctggaatcaccaacttggttagagaaactgatttttcttttttctttttttttttcccaaaagagtacatctgatcattttagcctgcaactaatgatagagatattagggctagttaaccacagttttacaagactcctctccccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacaccttgctcctgcttctgctacgaccttctggggaacgcgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagctggcatctgcctttctatacaaagctactattaatcgacattgacctatttccagaaatacaattttagatattatgcaaatttcatgacccgtaaaggctgctgctacaatgtcctaactgaaagatgatcatttgttagttgccttaaaataatgaatacatttccaaaacggtctctaacatttccttacagaactaactacttcttacctctttgccctgccctctcccaaaaaactacttcttttttcaaaagaaagtcagccatatctccattgtgcccaagtccagtgtttcttttttttttttgagacggagtctcactctgtcacccaggctggactgcaatgacgcgatctcggttcactgcaacctccgcatccggggttcaagccattctcctgcctcagcctcccaagtagctgggattacaggcatgtgtcaccatgcc

SEQ ID NO: 138576 - DNA, 1054 bp, Homo sapiens
ttctgagctccaacactccagtgaggtgaggtacagcaaaaaccagaggccagtatattctttaaaaatatcaaggtcatgaaagataagaaaaactgagaaactgtttccaattaaaggagactgaagagatatggaaactaaagttaagaattcattcatatttggatcttttactaaataatttttgaccttttgttctaaaggttgacattgggataattggtgacatttgaaagaggtttttagattagatcataatgttgcatgaatattaatttcctgattttgataattgtggttatgtaagagaatgctcttgatttttagaaacatgaactaaagtatttaaagataaaggggcatgatctccatcttactctcaaatgattgagaaaaaatagtgtgtgtgtgtgtgtgtgtgtgtgtgtacagaaaaagagaaaaggataaagaaaatgttgcaaaggttaacatttggggaatctgagtgaggagtacgtggaaattccttgtacttacatttatcctttctactaacagagcttcagatgaaaatcacaaccctggccaacaccttgatttcaatgcaatgagaccctaagtagaagattcaggcatactgtgcctgtacttctgacccacagaaactgtacaaaaataaatttgtgtgttttttaaaagtgaggccaatggtgtgtaagaagaatttgaagtgggaaaaaagggtagattcaggagacattatggagagaaaattgccacaatatggtgttttccttggctagatatgggtagagagagaagagttggggatgattctgaagttgggagcctagaaattgggataatgctggcagaaagaggcaaatagagggagagctgggtgggagaaaaaaaatgatgttttagaaattctgagcttgagtgaacagaggacatgagtaaaagggaaccatctagtggaaaggaattggttaaggattgaagctgaacagagaggtcagggctgcagccagaggtttgggaggcatcaccattgttttggatgtat

SEQ ID NO: 138577 - DNA, 1090 bp, Homo sapiens
aataacaagctaaacccaaagctagcagaggaaagagaccaataaagattggaacagagataaataaaaatagtgaatagaaaataaaataaataaaatagaataaaatagagaacagcaatgaatccaagagatgtctctttgaaaagatcaacaaaattgacagagtttatagctagatcgactaagcaaaaaaaagagaagcctcaagtaactaaaatcagaaatgaaagcacagacattaccaaaaatgttaaaggaataaaaagattataagggagtacaatgaagaatggcatgttaacaaatgtggtaacctagataaaatggacaaatttgtagaaacatacagcctaccaatattgaattatgaagaaatagacaatgccaatacacctataactagtaaggtgatgaaatcagtaatcaaaataatttaaaggaagaaaagccaagatccaatgggttcacctctaatttccacaaaacatttaagagtaattaacatcaatttgtttcaaactcttaaaaaattaaagaaaagagaatatttcctaacttactctatgaagccagcattaccctgatatcaagctagaaagagacactgcaagagaactacagaccaatataccttatgaatattgatgcaaatatcctcagcaaaatactagcaaatagaattcaatagcatattaaaagggttatatgccttgagtaagtgggatttattcctcaaatgcattgatgggtcaacattaaaaaaatcaatcaatattatacaccacattaacagcatgaaggggaaaaccacatgaccatctcaagttacacagaaagagcattttacaaaattcaacacctttttgtgatttttaaaaagaactcaataaactaaaaatagaagaaaactacctcaacataataaggccatatatgaaaaacctacagctaacatcatgcttaatggtaaaagactgaaagcttttactcaatgatcagaacaagacaaggatgtcagctttttggcacctctattgaacatagtattagaatgcctagacagacagcaattaggcaagaaaaataa

SEQ ID NO: 138578 - DNA, 1110 bp, Homo sapiens
agtgattttatccagttccatactttaaaaaaagtctgcctgttgatgatgctcatattcatatcttcagctctcacctctccactgagcttcaaacttatatattctcctatctacctaacatctccacttaggggtctaatagcatctcaaattttatcatggccaaaaacaccctcttgatctgtgcacttaccacatctgcaccaaattatttctactgcaggcttccccttataagtaaatggtaccatttgtccaagaccataacctaagcctcattcttgatcctattttctcccacccaacacatcctcttcatctatctattaacaagttctattggctccccctcaaaaacgtataaaaatccatccatgttgtctatctccactgctcccacctggcccaagccaccaccatcttttgcctagaccactacaattgtctcttaactggtttgcacacttctactcttgctcttctatatttttactactaattatggggcctacagtgaattcttcacaaaaccttcaaagtgaggttttaaaaacataaatcagatcatgtcactcatctgcttgaaaccatccaatagcttcctgttgcaattaaaattcaaactccttccgatggtttacaagggccctgcgggatttggccactgcatgtctcttcagcctcatcttgtgccacactccctcttgctcactatgttttagtcttactgtctttctgttctgttaacaagccaattaaggcctctgcactgctcttttctcttcttggaatgttcttcccctagatctttacatgtgacaggcttcttcttgccctttaggtctcagcatagatgtcacttcacctcagaaagagttttcttcaccatgtaaagtagcctcccttccttgccatcacttcctaatacatcagcctgttttattattgttatagtatttatttatgtcaaatcatcttatttatgtgtttattacccaatccccacacacaactaggatgtaagcaccattagagcaggaaccttttctgtcctattcacccttgtatctcccatgcctggaacagtgcctggtatgtagtagacac

SEQ ID NO: 138579 - DNA, 1049 bp, Homo sapiens
atcattagccaggaaaatccagttatatttttctatttcttaaaaaaggttcttgtttaacccaaataaatgcattttacaaatcagagatgttaacattgaataaattacattcattttgatttgtgatttttttagattatttttaccatggtgtagaaaaaaaccagtgggatgtggttgctttttttttttaactccaaagttagttaaaaagatatctgtaaaatcactggagtcagaaccatcctgattccaacttattaatgaaggatttgagaaagagtgttgtatatttttgcattaaagacaaccacgacaccaaaaaagctatttttaaaaatgcctgattttttaaaaatgccaatcttatatagtctgtttcttttaaagcaagtatgtattttaacaaaaccagtaataccacatttaattcttagcagtagtaaactgtatcatattagaaaaagcatggactttggactcatttcgatacaaatcccagctctaccactttctacaatgttaatgtaatactcatatatgcattaatatatatattttgaatttaggaaaataaaatgcaaactgacccttaaaaatggtctggattacatcgtttacttagtctttgcctccctctttcttgttttggcatagagtggatcattgttgttgtttttctcaattccctgtatcatcacaatttaaaatgaatcagtccaaaagaggcatcccattcttcaactgcctgagatgttttgtctggcgaatctgtagctctttttttttttttttttttttttttggagacggagttttgctcttgttgcccagactggagtgcagtggcgcaatctcggctcactgcaacctccacctcctgggttcaagtgattctcctgtctcagcctcccaagtagctgggattacaggcgcatgccaccatgcccagttaatttttgtatttttagtagagacggggtttcatcatattggtcagactggtcttgaactcctgacctcaggtgatccgcccgcctgggctt

SEQ ID NO: 138580 - DNA, 1095 bp, Homo sapiens
agacagggaaagagagaggtaatctctcctagtactctgaagaaaaggggtatttaggctctttgcctatcatgaaacaagaggcttatgtcttattgctgatgaattgcaagtgtaattacagagcattgctaaaccacattaagtcccaagggctgaataaaaaaatatacaccatctacaaaagccatttaaattatctctgaaaaacctagtagtcaagtatgaaatcagtctgtgagcagatataaaccattgctggttatccattaaaattagctccacaatgctaagggccagtctctaaaagaaaaatgaatggcctgtggctatatctaatgtgctactcacaagtttctgtactgttacagaaatgaacaacaacagttgaactttaaagataaacagttttttttatcggattcctagagaataatggtgcttatgtacaattcttgaaatagagcctacagccgcccaaaataaaatagtctctttcaagatcttggaaataatgacatcataggcagattgaaccagcaatccattaatagtatcctttatagaaagctgtctcaggggaacacatggctaagtagattggcattgtttataaacataacataataaaatccctttttaaatatgtttgtggaatagtaggagatacttcccacttgggaaacaaatactttaaccacaaggattccttgcaggtccctaccctttctccattggtcttctaaaagtgtgcttagaggcacttgatttgaaggtgagttaaaataccaaggacctcctgtactattctttcaacagcaaagcagaattatctggaatcattagcagaggatgattggttgtgccttgtaatgggtagtaaagaaccaaagtaatatcaagataattaaaacaaaaccatatctgaactgtctaggaaaatggtttggttcaagctttattaagttcctagtgtggacctggacataggttcttcagtttcacttgtgtctttgtaaaaggtgtattccagctcctcttatgatgccttgattagttgaatgacattgaaacacttccagtttggtgggcaat

SEQ ID NO: 138581 - DNA, 1694 bp, Homo sapiens
gccaatgcacaaatctgggctgcattctgactttgagcacagatttaatttattagctatctcagtttaaaagttagatataacagaatctggagcatgtttttaactgcttatataccactcagaaaagagttgtgcctactttttatgtgcctagctctgtgctgattattgtgagggatactacatatgagacaaggttccctatcctcaggtaattttcaacatagttgcagaaatcatacacacacacacacgccgagtttgtgggaaatgtccagtaagtgatcttagagaaaacagatacagtggtggggaggtcctccccattccactcccaccattcattcttcttttccacctgagtgaaacagcaaccatctggaagcctgcccccaccatggcatgtgtacctttagcagcacacagctatctagcttgtcttctcacacctttttttgttgtgtcattcaactattcaaaaacctttctcagcatattttgtattactacctccgatttcatctttcttcccttcctgatttccaaggctacaccctacttatttattgtgtcttctcatttcctcatcaacatgcaatatgcatccctacttccaaccttttacctctactgttcttcctcgttgagatgacttacccttgcatctaggtatccagtctttaaggcccatttctcaaaacatacctcctccagtaagccctgactgtccaccacagatttctgtgatcttttcttttgacatgctactatcctatattctgcccaacttagcacctaattttctttggtagtttctgttgctatttcttgtttattaaggttatttccccagttagatttcaagttcagaatattactgaagtttctaatgaatcacccagaataacctgtcactacagtgatccacaattcaatatagttgctaactgactcactgattcaaaggaaaggaagctgggacagtagcaggaggaagttgtgttttagagccaaggttgtaaaatgcttgcctcatagaactagtcaaactatgtgtttatttttctttagaaaaattatttctgcagtaaaaatgctttatatgatattttgcttttagctttctgtattaacaaggcttcaaatgttgcttttaaaattatgacatgtaccataatattttgcatgcttttcattgcttttaaaaagatgattattgttttgtgcttttaggctaaatttatgtaggaaagcatttccctatgtctgtcttctgccatcctttttcttttcctgcatgctctgttttcaagaagctagaaagagttctaaaaaataaatctgaaaatgaccatatgacatccagtgaataggcccaacaaaacttccaggaattttaggggaagataacaaatggaactcctacaacaaggaagactcaggtgagagctttctaaattgctttcagaaggcagccatagcaccatccagggatttcatcttgggggagaattggttgctttgctcaaccttgaaccatgcccagctatgttaccatatatgcctttggccccaaagtggtacctggcaagaggtgtgcctgaatgaatagagtcatccccactgttgggggaaaaacagcaacaatgccaccaaaaacaacttcaactacaaaaacaactgtaaaatat

SEQ ID NO: 138582 - DNA, 1083 bp, Homo sapiens
ctacatttcaggactctgtctataggatggattttaaggagctcatcctatggttaagggagtcagaaggatctacatttaaatcatagacccattgctattagctgtgtcacctagggccagttatttaaattttctgggcctccattttctcatctaaaaagtggggataatgataatataaaaacctcagcagcagtatcaggcacatcataggggctcaataagtggtaattgttattacatgggtataaagccttcataagataatacaatgggtcaagctttgaaataagtcatcactgggtctgagtcatagacttatactagctgtatgtccttagtcaagtcacttaacatctctgaacataattttcttcatctgaaagatggagataataattgtacccatataataggggttgtgtgaggactaaataagttaaagtatataagacatctagcacaataaacagtaatataaaattgttattatgctatttttacagagtgagagtgatcatatttttcagcataaaaatgggggtttggggtcttacagtgtgacagaatgattgaaaccaggaataatcccaggtgtatgattactgtacagaagccatcaagtatcttggactcaaaggccacattggagcttggggaaaaagtagagcagcctgtgctgagaggcaaaagagaggaaaaagggaaacaggcaggcagaaagatggccaatatcccataccagagtggacctcataagcatggtgaagagtagatggcagcctctactaaaccatccttaccttcagtgtcaggggtccagttactaagaggtgggcagcccagaccacagagctattcatcttccatgcagatgctgattgtggtggccagagcaagaggtcattattgggtgaaatgaacaggtcatctttcagttttacacagacaaatagcctgggtctggcttgttcattgtggtctgtctagatctgttgaaaaatacagaaacaagaacagaaaaccaaacactgcatgttctcactcgtaagtgggagttgaacaatgagaacacatgga

SEQ ID NO: 138583 - DNA, 1036 bp, Homo sapiens
cttctaacttccacctctgggattcaggggattctcttgcctcagcctctcgagtaactgggattacaggcgtgtgtcaccatgcccggctaattttgtatttttagtagatacggggtttcaccatgttggccaggctggtcttgaactcctgacctcaagtgatccacccacctcagcctcccaaagtgctgggattacatatgagagccaccatgcctggccagatgcttgcttttttaattgccagctttcattgtaaagagttagcatggagttacatacgaaagtgttcaatgaggggtattttgatatttttagtagggaaattttattaagtatctttataaagtcttacaattttacattgtcaatatgtttcactgagttgcatctattattgtttatggtggtcaaactattccatctttagctaatgggagaccctttcactgcattagttttgacagaggtcttttaatagcttgtttacgacatccaacacttgcagttatgtggtcataccctccaaaataacttattcacatcctttctttgtaattctgacaggtactctctatgagcatccaaaactagcattaattgagaagatatcaacctaatatgtcctttccaaactgtattttatagttaaaaataaatgaatatggataagtaccaatcacatgaaagatttttataagaacttgcatataaggcagctccatttttatgaggaaaaattgggaggagaaaacccttatcttgtatttgggtatatatggtgcatttctgtgcatgcatgtatgtttgttgtaggtatatttttagcacaagtggtaacatactatatatctccttttttattgtgtttctgtgttttagagatggttctatgcttgtacctcatactttttaaacagatgcagtgctttgttatttgaatagtaccataatttattgaactaggccctaaatggacatagacatttaatttgtttttgatgttttgctattataaacaaggcttctgtga

SEQ ID NO: 138584 - DNA, 1470 bp, Homo sapiens
ccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaatgtcctgagttaggaatagggcagtgggaaagtcagggaagggtgagaagcacagtagagattatttatttaaaaaaggaaagaacgttaatgttgttagcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctcaaagatcgtgtaaataattatattcctttgctcaatgggtttatttctaatgaggctgccagttctgagagattctataatatcacttttaaataacataaacagggattacaactatgtaaaaagaaatgcatatggacaaagactgggaacacagataattgaaatcagttgtgttagggtggtggaattatgtgaatttttttttctttttaaaattttatttgatattgttataatattgctttacaataaataaacagcagaaagggaactatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctggaacgttttaacagactctcaggt

SEQ ID NO: 138585 - DNA, 1129 bp, Homo sapiens
gcaattaaatatttttggcattgaaaacaatgaagtacccttttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacgatgacctggaaggagatgtttcgacaacttggcacagtaacaatgacgatgtgtatagggtgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggatgttgctgatcaagcacaggataaagacagggatgatcgttcttttggccgtgatagaaatcgggattctgacaaaacagatacggactggagggcttgtcctgctacagacagctttgatgactagaagaggtgatgatagctttggagacaagtatcgggatcgttatgattcagaccggtatcgggatgggtatcgggatggcccacgccgggatatggatggatatggtggccgggatcgctatgatgaccaaggcagcagagactatgatagaggctatgattcccggataggcagtggcagaagagcatttggcagcgggtatcgcagggatgatgactacagaggaggcggggaccgctatgaagactgatatgacagacgggatgatcggtcgtggagctccagagatgattactctcgggatgattataggtgtgatgatagacgtcccccccaaagacccaaactgaatctaaagccttggagtactcttaagcaagatgattcctctgctagtacctcccagtccactcgagctgcttctatct

SEQ ID NO: 138586 - DNA, 5932 bp, Homo sapiens
gtagcttgggattacagccactgtgcctggtaaggcacttttatttttcatatccccttagccaactcgaagtaaaaccatctctcaaatgtatcttgacaaaacctggcagcaaacaaaaaaatctcaaacttgtctgtcattaaaagattgtggtacccacgcaacgacaccaactcaatgcttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtgccgctgccccttagctggcttctgcccacgcccggcggggcccttctccggctacccggccactcggggttgcctgtttcctcttcccattattccggccgctcctctccctcatttcttcagctccttttccggtctgcccccgcgctctattctccgcctccgcgtcctccgcccctccttccaacggctccgcccctccgagctcgggttttccaccgggctcggcagtttttcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaagtgaggcagaacgggtagtgcctgggttccccccgagtttgcgactccttttccaaagtcttttcctgctgtggctttcgcgggactctgcgagctgggtcgcttagattcatgagtgcttgggaggttcctcgtcgggccccggaccagaaaatagttttgaaaactaagtgaaatcggccacagataggctttttggcggccgtgctccgatgttaacgtcaaactttagtagtggtggtggttcctgctctgttttacatagccagtttaaaaggccctcacattctgatttcctctttcagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcctaagaatctcagggttgggtcttttaattttaattttttttaagttctggggtattctgggggtacatgtgcaggatgtgcgggcttgttacaaaggtaaacgtgtgccatgcatcacctaggtattaagcccagcatccattagctttttatcctgatgctctccctccaataaggaactgacacttgaaccttttcgaggtaaaataaaatcgctagctgaactcactgtagccctttttgaatacacaacttatttgaatatgacaattgagaactttactggagagaacttagtattttggggtgagagaagaatgggaaattaaccactgtagtccacctttacaataaaaaaccctaaacacagaggagcaaaataatttacccggggaagtgtaataaattgtcaacttgacattagtacttgggcttagatctaaaggagtgttctgcctgctgattggttggattggtcatggagaaattggaattgtaagattgtttacatttctgttgaatgtgagtgaaatgaatccagtcaaaaataataacagctacatactgtgtaaattgtttcctcttcagaggaccgccctgatggtctagttaattagacttctagtgcattcagaagaactgcttttggggagcaatgcagttttgactgttgtgaagaaaggtgtttcgttttttcctttcttttttttttttaaagtctagtttgaggagagaaaagtctttagaaatagacattaccaacagattcgtgattaaaaatgtatctcctaggaggtaacagagcctttggcactgctctgaatgctttgtgtatattaactttacttttttaaacaatcctgtgaactaagtactgttagtatctccattttacacatgaggaaactgagacacaagagtggttaagtaatttgtccagccgggaagtggtggacagataacaatctggtgctggagtttatgttctttttttcttttcttttcctttcctttctttctatttttttttttttttttttctgggacggagtttcactctgtcacccaggctggaatgcagtgatgctatctcggctcactgcaacctccacctcccgggttcaagcgattctcctgtctcagcctccccagtagctgagattacaggtgcacactaccacgccccggctaattttttttttctttgtattttagtagagacggggtttcaccgtgttgcccaggctggtctcaaactcctgagctcaggcaatccacctgcctcggcctctcaaagtgctaggattacaggcatgatccactgcacccctccggagttaatgttgttaactaaccaccctagcataagatacccaaaaaggacttatctactcacttatcaatctccttgctctcatttaaaatagttagatgattttacatttcaaaattgaattgatcctaatattctatatttgcatattcatggagatctatccttgactatttctgggatagcacctcacatgtaaacccataagaagtggtcagggtttttcattattgatgcctgtctgtctctattgtaggcttgcttttctacttggggttgaatagaaatgaagtatagtttcacatacagtatgtcaaacctggatcttatttggattcaaggccatgcccaaagcatactccagatggcccatcgtacaatggtttcacttagagtttttcaactttatggtggtgtgaaagcaatacgcatacacattcagtagaaaccgctcttcgagtacccatataaccattctgttttacacttggagtatttaataaatggcatgagatagtcaacactttatcataaaataggttttgtgttagatgattttgcccaaccacaggctaatgtaagtgtgttctgagcatgtttaaggtaggctaggctaagctgtgatgtgtggtgggttaggtgtattaaatgcattttctatttagaatattttcaactgcttttttttttcctttttttttgaggtgagttctcactctgtcacccaagacagggtgcagtggtgcaatcatagctcacttcaagctccaactcttgggctcaagcagtccttccgcctcaggctccccagtagctgggaccacaaccaccatgccttattgtttttgtttttattttgattttttagtagagacaaggtctctctatgttgcagagagtggtcttgaactcctgggctcaagcgatcctcccacctcagcctcccaaagcgttgggattgtaggcataagccactgcacctagcctgttttcaacttatgatggggttataccccgtcacaaggctataccccatcgtaagttgagggtcattggtactagagagcaagtagcatagcactgaatcataggccataatgtcatcatcagtgataaagtaatgtatttttcaaataaagtttctagcactttttattagagagcaactgataactatactcttgtcattttgaatgtataattgaaagacctagtttgtagttctgtcaacttaagttttttaacttttgatttctagctataaagcttcgtggggaccttaacttatttcaaattgtgttgaacaaatttgatttatatttgtaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatctctgtgttgtatttctatgtgtatctgtggctgtttctttgcatatgtgaatatctgagagagtgtgtgtatgtgtgtttatttaggcgtgcatgtctccaagacactaattttggagttctaaattttgagttcattatttagattttcattattcaaggaagacaatttgctcattttagttaaaagttttgcctatagtaaatccactaaaatccctaaattatatttactctttcatttattcagttacacccaatatataaaaggcactgttttaggtgctgtggatacagtagtaaacatgagataaagtccctgttcttatggtgcttacattctagtggtggaaaattgataataagttcacaaataaatgatcaaggtatttcatgtggtgaaatgtactatgaagaaagtaagacagggtgatgtggtagctggggtgaagactgattagaattgtcagagaaggcttggcagagtacctaacattttgatctgagacccgaaatacaaggaagagccagtcatgtgaagatttggaggcagaaggaacagcaagtgcaaaagcctaagtaaggaatgaacttggagcttggtgtgtttgaggaacagagggaagattagtgttgcaggagcatagtgagcaagggaatataatagaagatgaagttgggtgggggtagcttatgtaagagttctgattttattcatgtttattgagaagccattgaagtattttaagcagagaaattatggtaaggagtattattttctacaagtatattagaattcaacaggaactgatcatcgtaatagaaggatgaagaaaattacttgtttgttttctattagttcttccttgagacactagaagcttgccaaagggccaggtcagtaattcccacttgtttgactttaaaacctatcctagtttgatgttgcaagaagtaaatgcctcatagaattactatatatgtgtatatatatatttatttacattatagtaaaatgaaattaattttaaaataaaaaacctgagaagaaactggctggagcataatttttcttttagttttactgcttctgtctcttaggcactcagtaaatacttattcattcattaaatatttattgagtaccttctatgtgccaggcattgttctaggcacttggtatacatcagtgaacaaaacaaagactcctgttcttaactgagaggaggcagattcattgattatttcaggagtgaaattgttggtgtccttatcactataatgttggagaagagggaatgtcagggtggctgtgtaacatagaagccagtcttgaactatttagtgagtcaggagagaagctagattaaagagga

SEQ ID NO: 138587 - DNA, 2651 bp, Homo sapiens
gggattacaggcatgcaccaccatgcctggcctaattttgtatatttagtagagacggggtttctccatgttggtcaggctgatctcaaactcctgaccttaggtgatccgcctgccttggcctcccaaagtgctgggattacaggcatgagccaccacacccagccaataattggttatattttcattttaggtaaatcatttattttccccagacctaggctggggggtagtatgtttgttctaatttaagcgattggtttaaataaatttccgatgtaatggttctatgtttaaaaccttatttccagcatacatggtggtgtggtatattgtttaattgtatatgaagttatgatagtaaattactggcaaagattatttcacagtcttcatgcatggtctagtagtttccccagcttattatcttgtctggcagctattacttttggtttcaatttttaaattctgttttcatgaatgaattgtgcttcagtttaaatatgcccagtcctgagaagtattacaaagccatgtgaagacatttttcatgaaatatcatttctgaaatatatcagttgacataggagataaggtatctgctgaatttatattgacattttatagtactctttgtattgctttaataatcctagtatgtatacttattaaaatatataaaaattcacatgtgcagtttttagaagtaccactatattcttggaagttagattcagtcatcagtgggcagcagatgaagtatggaattttctcccatgttacctaatatttttcttcttttgttttagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaatatatggttttaaaattgacttaacttgagcaagatacattatgaagttctttctgattagagtgtgtggtctcaagacctttacagtagattatccttaagtgtccatagctctctggtacaatgtttagatatagtttatctatcaaaatagaacattcactataaagacctctcttccattccaatcatattatcccaacatgctaaatgttccaaacattttatttggaatgcattttatcatgtttttataggtttatttttctgattgtgttttatttaggctaatattaaaaaaatgcttactagtggtagaaggtggtgacaaagaaatactctgggtagcaggaggaagccaacttggattaaaattttgctgagaataatctaaaaagtgagtaatctggttgagaattcacagcaccataatcataattgtatatcaatgttatgttttaggaaaggtcctattcaaatccagggagagaatctttagtgttttctgggccctcataaatacgtttttctcatttgagaaaattgtgactttatgttggtcacttagtttttatagtttatgatgaagaattaaagagaaacaaatgaaaggcaaggtctactcaaatatcagacaactaaaaggctatacagcccctaaatcctttgctatctacttccccagaataatgcataacctaaattccattatttcatttagcagaggtttaagccgttgttgtcaattgtgtgcagtaacgcctctgacttcccttttgtggaattttgtatcgattttggatttttaagtcaaaggagactttaaaatcattttgatttggcacggattcttgagattatctagtccaattccatcatattcagattttaccatttgcttaaagtatagcttttggcagaactgccc

SEQ ID NO: 138588 - DNA, 6455 bp, Homo sapiens
taaacaaaaacttgcatgtgaatatttatggaaatattattcataatagcccaaaagtggaaacaacccaaatttctatcaactaatgaatggataaacaaattttggtttatgcaggggattgaactatgtagtgatgcaccatgctccaacatgggtggactttgaaaaccttatgctaagtaaaagaagcgagtgacacaagaccacatactttatgatcccatttgtttgaaatgttcagaatatggaaatctatagattcaggaagtagattagtggttgtctggggttggtggggatagagggattagaggttgacagctacaggatgcagagttttattttgggataaagagaatgttctaaagttgattatggtgatggatgcacaactctatacaacaaaccattgaattgtatactttaagtgggtgaattatatggtatgtgacatatctgaaagctgttaaatttaccagttttaagagtacaatttaatttttagtgaatatacagaattgtgcacatatcaccacaaaatagttttagaagatttttattattccagaaagattctttgtgcttatttgtagtcaatgcctatttccactccagccccgggcaaccacttcatctgctttctgtctctagatttacccttttggcatatttcatataaatggaatcatattccttttgaaatcatacagtttttgcttccatcttcttaggaccagtttctccaatccttgttaatgcttgttactgtctgtattgtttattacagctatcctggtaggtatgtaatgatgtcttattgtggttctaattttcattttcctaaagatcaatgattttgaatatctttttatgtgctcattagtcattcttatatctttggtgaaatgtgtattcaaatcttttgtctatttaagaaattggattttttttattgttgacttttcagagttctttatatattttggtacaaagtttttctggttagatatgtgatgtaaaaatattttattccagtctatggcttgtattttcattctcctaacaatgtcatttgcagagcaaaagtttttaattttgataaaatcgagttaatttttttttctattatgtatctgagaactcactgcctaacccaggatcttaaagattttctcctatgttttattttttaaaattttgaagttttattttacatttataccactttgagttaattatagtacaaggtgtgaggtataggttgaggatccttttttttgcatgtggatggtcaattgttctggcaccacttgatgaaaatgctatcttttttctattcaactgattttgcacctttgtcaaaaatcaatggaccatatttgtgtggatctacttctgtgtgcttccctgtgtgttaacttttctcttgctctgtctccttttgtcttcctgtccctacttgtgtttttttttcagttttctattacttttctgattctctccctccttctcctgattttcccttcccccattcccttcctcaaaatgaagcatttagattgcattgttttatatatcatacttatttttagtttaaaaagcagatgtgaagcatttgtgtttttctttacaagtacaatatgctggaaacaaattaacttttaaattataatccctttttttttttttgagacggagtctcgctctgttgcccaggctggagtgcagtggtgtgatctcggctcatgccattctcctgcctcagcctcccaagtagctgggactacaggcgcccaccaccacgcccagctaattttttgtatttttagtagagatggggtttcaccgtgttaggcaggatagtctcgatctcctgacctcgtgatctgcctgccttggcctcccaaagggctgggatcacaggcgtgagccattgtgcctgaccaaattataacccttaattaatttttctcagtgaattagtgaccttaacgaaagatggcaatctctcttcccaaactgtgtgtttcagaacttctgcaaaaggcatcacttctccagtgttacagtttctttaaaaaagaaattagtggctggacatggtggctcatgcctctaattccagcacattgtgaagctgaggtgggaggatagctttaacccaggagttcgagaccagctgggcaatgtggcaagaccccatctctacagaaaatagaaaaattagctgggtgtggtggtggcatgcacctgtggtcttagctacttgggaggctgaggcaggaggattgtttgagcccaggaggttgaggctgcagtcagctgtgttcacaccactgcacttgcacttcagcctgggtgacagagtgagacactttaaaaaaataaaaagaaattaaggtaatttcaaattggcatgcaaaggaagtcaagatttattccttttttaccatgtcaaacattatttcattcccaaattataaaatattgctgcttttcctagagggagcagtcatgattactactggatccacagatacaaaaaaaaaaaaaaaaggaaaaaacaattttgaaagcagcttaatgttgtgccttctctaaagccagcttttgacctatttatttttaatacttaaaaaatgtaagaaaggaattggatttttgcatttaaataaaaataaaagacactagatagtatagataataggaacaaataaaacaagcaattgggcctgcctttggcacttagtattttctttggttttctcagaatccagagtaatgtgtctggaaaagtacactagtaaaacattgaaacacatctctcattgtccaactcatctcatactctaccataccatttcaaatgtagtctatccatttgtggatattttcatgctgcttccatttaaatttttatttccatttttaaagaaacacacttttttgcatttttcttttttattggtgccatatagtagtttggaggcattagtcaagaattgtataaagtttccctagcatggctaataagatttagtttctgtgatcctggcagagattattatctagaattaaatgagaagattacttcaaccctatatctgaaatatccaggtaatagccttggcacttagcttgaactgtgccctctgccgctatagattaagggaagttccttctccttttttgtgtttattaaaaaggtattaatgcaaatgcttactggttaactaggttcatgaagattctgtccctccatgtttccctgaaactatgaaaggagcagggaatttggggagagactgtagttgaaaattcagctagagatcttaaagcaattcttcaagcaatgtaatgtggaccaggctgcatcctacacacctgagccttattgtagtcccttttcagcctcgtgcagcagttgccccgagttaagctgcaaagtcagtttccttctagacccaaagctcagctgcttatgcatacttttctcaaccttggtctgattgggttagattgggttaattccactctttcccaaggaggtaactctaagtactttctccctccctcccatgtctcctgcttagtctgagttccctattcctaggaggattggctcttcctcttcttttcacagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcaggtaaaaggaaaacatatcttccctgtactgagttttcagagtttgagacatgggatggtcctgtagtttgccagaagaaacaaaaaaattcccctgctttctagtgaaaacatcgggcctgtcaaggtcctagagagaagctgcctgctcttattagcttggtgcatgcctttgctgaatagtctatattgctgaacctttgctatcttttctgtttttttaaatgccagtttgtaatgtaggaggggtaagataaggaggctaaagacaactttgaaatatatcttgatcctttgtaagcatcccctgcttcctctaattttaatgcctaagaaaaaaattataggctgtgcacataaggagtagaaaaggggatggggcatgacagtcatccttcccccatttcgttgaagatgatattaaaaaaacttttagtaagatgatttaatttcccaatttcctacatatgttctgaataaggaagccttaagtgtccagttcatagtcttgatttagaagtgcctattttaaatgactactgacagtgggctggtctttctcttctttttagttgttttgcagccaggtccatcatttggaaatcaggaaggcttgtgtctcatatatgagggaaaatcaacaaacttttgagtctgtaagtagaatacatacccaggggagaactggtagagtgtgtagcaggtggaaaaataattgtgagcacctaccaaaattaaactatatcatgctgtctcctcaatagcaaatatataattcccaactggctcccttcccagtagctaacatgcttcttgagcctctgctagaattaggttgtttaggactctaattaaaaatcaagaataatctacattttcccactacttacctcgtcctacgccaagaactccagaccctaaaaagttatgttttgattgctgttttatattatccatacagttttattgaacaattaataatagttcatgaaaggtttggctctgttaatattttgcaatgcatattttaaaatacgtaaaaatgggaaccccctctattttcttgcttaatcctgtgtacaataatcttcagccagtcaatttgaggaatcttgtaaaacttaattgtaagggaacaaatgagtctaagtatctagtctttccatgtcacaaattgtataattagagctctgccactaatgattaactttaggtaaaacaacttacagaagacatatttgtacaccttcatgtatttgaattcttgttaatgaaattggaggcttccttttcttttttttttttttaaacacttctggcccttgcagtgctatttgtttcttctgtttattgtgggtattcgcctgctgttcgagttttactcctaattttctcaactggtttcagtgaattttaaaactatgtgaagacttcttgacttaaaagcttgttaccttgaagttcattgtagtcttctctacacctggggaaaggattattagtaacattacttcaaatgcaaggccatagtgtaaagcagtgcgtctcaagtatttctgtgcatacaaatcacctggagatcttgttaaaatacaggttttcattcagtaggtctgagttggggcccgagatttctttttttttttttcttaccttgagacagggtcttctctgttgcccaggctggagtgcagtggcaggatcacggctcgctgcagcctctgcctacgaggctgaagcaatcctcccacctcagcctccaaagtaacttgggactacaggcacacgccacctcactgggctaagttttttgtgtttttagtagagatggggtttcgccatgttgcccagactggtctcagactcctgggctcaagtgatctgcccgccttggcctcccaaagtgctgggactacaagtgtgagccactgcgtgcagtggagatttctgcatttttaacgaactgaagtaatgcttgctattggtttgtggacaacattttgagtaacaaagatgtgtgtaaaattttaaaactacgtaaatgaatctcaattcagtactgagtgatagaaaccagaccccatgcaaagtttatactgtttgatttcccttatataaaactctagaaaaaatacaagccaatctgtagtgacagaaagcagatcagtggttatatgtcagttatagaggggcacaagggtacttacggaagtgatacattcaccatctcaattgtgatgatgatttcatgggtgtatacataagtcaaaatttgtactatttaaattgtgcagtttattgtatgtcatttatttattttttgagatggagtcttgctctttcacccaggctggagtgcagtggcacgatctcggctcactgtaagctccgcctcctgggttcatgccattctcctgcctcagcctcccaagtagctgggact

SEQ ID NO: 138589 - DNA, 2778 bp, Homo sapiens
taccatttttagttttggagatgatatgcaatcatggaactaccactgcagtcaagatatagaatgtttccgtcacccctaaaaggttcgcttgtcccatggtctttttagaaactaatgaaattctctttaaagttcctcagtttaattttgtaaatgcatgttttgtcaaatttgaaatccttagaaatactggtcttgcttgatttatgaaaattgtcattacttaaattggcatttcaaatgaaactcgaaagcataccatttgatgaaatgcactggtatgtggatatgccaggaccaattcctaagatacttttatactccagcttttctccactcatgacttttgtgtatgtgcaaatcttcttgaggtgctgtgcaaagtagatacttacaccataattgttgagctgagcaaaaaacgcattgcaggataatgtagaatataatcagatttcagtaatgctgtgtatttggttaagttgagtttgttttatttttgaagtatgtggagggatcttttgagaaatacctggaacggttgggagatcccaaggtaagatcaaatatgggggtttaatcttttcagagttatttggaatagtaatgtaaatttattcattcaactgtattattttagccagaccccaaatattttatttagtagccagctgtgttgaatccaatagttctcacataagtttagaggctggcaattgaccaattgttttgtgttgaatattgataattgtgtgttaatcccatcaaccatagactagcaaaagagtatacactacttggaaacaggacaagcttaagccttttcactttaacgggggaggagggtggtaatgaattttaccaagaggtcattattttgttattaaacaattcccctgatttgtagttgtcttcctcttatgtgggagtaaaattcataaattcatgctttatttagaaataatttttatgtgataaagttaattccatagttctggacttaaaaaagcacatttactaaatccctactgcctttttattatactagttccatttttattgtgtttttaaaatctctcctattaactgtccttattacttaatggctaagtagggctttagatccttctttcaggataagtttatgttaataagtagctatcacagtattccaagccttaaaacaggttatagtgtgttctacaaattcttcatctaaaacagtgctaagcagctaaaaatttgttgtgcttgaaaaaactacctcctagctacagaatgttttttaaaactcaatacactatttatgtttaggaaagtgctggccagctggaaataagagctctttctctaatttataagtaagttatatcctcttttctttgagagtgggtatgtgcatgcatgtgtgtataagatctcaacggtctcttcaggattggggaaatttgagatttgatgtattgatacctagaatgaagaaagctaagaaaaagtgttaaaatattttaaatggttgaaaagtcaaaagaagaatgtttcatgggatggaaaaattatataaaattcagatttcagtgtctgtaaagctttgttggaacacagttatgctcattcacttacgcattgtctgtggctgctttcatgctaccaaagcaaagttgaataaaccatatagtctgcaaaagctgaaatgcctattttctagccttttgccaaaaaaattgccaacctctgctttaaataaaggagagcaccatcccccaactcacagacatacatacaattgataattggttgtctttaccccttctcctcccaaattaagatacataaaaaaaaatccataggactttaggggcaattagctgtctaccttgaattaacatcatttagcccttttgggttattttaaagccaaacattaaaccggatatttatattactttatatgaataaggtaggcaacttaaaagcacaaatagttgttcctataactatctcttacgtatgccaaattatgtcttcccacttacctttgttttccccatatagtcgggatttcattctttatcgctttcctggaaaacctccaacttatgtcacagataatggctatgaagacaaggtaagaagatgagtgaatgttgacttatataaaagaagttgaatgatgcttctggcttgcctggatattaaatcatttttaacctaattaatgaaaagcatagtctgaatgacaggtttctctgttactagcattttcctctctagtcagttaatctcagtgttgttagccctctaaacagacctgatcgtcatttctctgtgataggaaaaaagccaccccaaaccctaattggcttctcaatgactaaaaaggataaggttcaaactttgaagctaggcattcagcatcctgaaaggtcccaaaccagcttcattttcttccatccttattatgccatgcttccaggtattctgcttttcatactttgtgtctttgtatttgaaactttcccaatgcccctggagtcattttctcactttgtgctcccttagcagctcccaagtaattgtagtgtttattatattgtgtttgttttcatatgtatttctttcattatctgaaagtttcttgagggaagtgacagtgtctactactgcctggtaaagtacttgattgttagttgagaatactcagcagataaattgtttgtcagcatacagcttctccaaaaagtttataaaagaaaagccctttatcctgattat

SEQ ID NO: 138590 - DNA, 2316 bp, Homo sapiens
ttgacttcagtactttgaaatggattattactgaaatagaattgtgatttccaaaaagacaagtgaagaataatagacctgggatcaaataactggattattgggagaagttagcccagggaagagtaggaagacagaaaaaaagaatgcttaggataatttttttttctgccaaggaggcttggtggcaacatctttccacagattgcagaatcattttgagtaactcaggttgctgataccttcaaaatggaagaaccttaatcactagggattatatcccttatataagacatttttttttgttttttttttaagagatggggatctcactatgttgcctaggctggagtgtggtggctattcacaggtgagatcatagcacactatagcttcaaacccctgggctcaagtgaccctcctgctgtagtagctgagactataggcacacaccatcccacctggtgaagacagattttttcaacaaaaattcagaaaggttttggaacagttatataaacaaatttcatcacatgcaacattttgactgaaaaaattttgcttaacaagcatggcctttgaattgttttgggaaaaaaaaacctctagggattcagggaatcagctcagacgttaaactgtcatttttgtagcctgagatgtgccttaattcattgaggaagtctctctagcagtattggtgctatatagtgtattgatatattgctattcagttaaatggataactttcgaaataattgaataaaatccctttcctcccttagtctgagtttggagtatttgggtatttgacctaatttttccagtcattcttggaagttagctgggtcttttggcatctgttaggctttctgttatgttcaataactcaatttctaagtgttcctttttttttttttttttttagcaaatttgtaaatcaggacttgtttggtatattaatgtgattgaggctcacagtgtaaccttagtagtgattttaatcttggcatttaaaagtcactgccaagaaaatctctatgaggtacaggttgcatttccttatatttagattttaaaaatcactttaaaaaaattcagttagttatcagttactgactactgactcaatttcaagttaattatcatcttaatttcatggttttaagatgtgtaacattcacttaattgttctgtgtgtttttctttagattctactctgctactcaagtagtggtcactatgattctgtgtactcaaaacaatttcagtcaagtgcagctgtttgtcagggtatgtgaaggctttataaattgtgggtgtgatttcagatgacttgttttcactcagggacccaccatgaatagcccctttaaaaccttgttggtacctatttgcacgcaggattatgactattttcacatagttaatataaatcttattttgacaattggaattttgaccattttttcttcagctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggtaataaagggaaaggggatatcatgataattatgtttcatacttctgtgcataatcatttgaaagtggaaggggcctggcaagcttatgagttaggttacatattcacacgtacacatatgttaggatatatatttttaatggggggagagttttaccaaagagatgtgtcgtgagatgcccagacttgggggttttgttcaggtccgttttgtattgctagaagaaacttcagaactatctaattacatgattctcaaactttagttgtataagaattatagtgcttgttagaaaggcaggttcctgggcctactgtcacaaaatttgaggtcaggatgggaccaggaatctgttttttaaacaagtgtgcctaagcattctgatgtaggtaggctgtggatcatactttgagaaaatactgattctaaagtagcaccatcattttctaggtaataactgaggttagttgacacatccagccagtagaaaatttctcagtgtaagttttgggagtgttttagtgtctgcctttggtatgcactgtgagtgtgcctctgaggaaacaactgttgaacagctctagttgaacactttgggtttgaaataataaagtacatgtcttatatttcttcctaattcctagttctgcctgcaaattcagataggtttggtg

SEQ ID NO: 138591 - DNA, 1192 bp, Homo sapiens
tgtgtagcaatgttactacaaacttgccagcttaaaacagcacatttttctcacaatttatgtggattaggaatctggacacggcttagctagatcttctgctgagtgtctcataagactgtaatgaggatgttggtcaggactgagttcttatctggagctttgactggagaaaagtctacttccccactcatggttcttggcagcattcagttccttcgagctataggactgagagcttcaagtttttgctgtcagttggcagaagtaaccctcagctctgctacattgcagtggtgaatatggctgtttgcttccttataggcagcagaggagagagagagaccagtaaaatgaatgaggcagggatcatagggatcaccctaagagtgtgttctcacaggagttgtaaaatataggaggtaatctgctaagtatattgtagcacatacttataaaaacgaagcataaatgcaaatgttggaatgaaaaagcatttgccttatttttagaactgagttaatttaccactaggtggtggtgtagtcattaggcttaacataagtaaattcttcatttataaaaagctctttgctctaaatcttttgaattaggatggaagagtggggtgcctgctacaatgctgaaaatataccagagggctacaataaaggaacagaagaaacaaaggtttgatattttctaaggcaaagaattttcatagtcttggcttgcagcatcatgacttaaactagttaaagtcagatattatattctagttatatgggttgagggaggagttggtcattttcctttgtgaaagtcttacctatctttaaacttcaaatgcatacttaatgttctttgaattcttatttttacagaattttagatttttcagaacaaactgaacacttcagaaatttcaagagcaatatgtttttaagttaaatattacaaacccaatatttagtttgtaatcagtcttctgacgctaaggtttttttcattaaggaatacaatgcctatctttattttattcaaactaggtgataatcatggtttaaagttagagaaacagaaatttcaccatccgtataggactaaaatcaaataggccttcagtttgaggctagctaaataagtcaaatactattatagcaatctctgtgtatacctgaggtgcttataa

SEQ ID NO: 138592 - DNA, 4134 bp, Homo sapiens
aagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagactaaggattgtgagtttgtagcatgattatttttgttttagtctccagaaaatccatcaaagatgcccttcccctataaggtgctcaaagccctggatccagaaatctatcgtaatgtagaatttgatgtttggttggacagcagaaaaggtaaagaaatatcaacaggatacttttgaatcctgacaaatccaggagtataattttgcaaattatggtgaacatctcttataagaaatactgttataaaaaatagcctgatgctttttatcttactttatatatgatttaaatccaaaggagggaacatagctttagaagtgggagggatcttttaaagcctgatgtttgcctgggacttcaactttgcaaagactgtgtggagacaatttttagatagcattaagaaacttagtgactgaaaacaagctcatcttaaattccaggtgttaagaccaccttccttgataaatgagtaggttaggcctgtgggtcaaatctgacacaccaactgtttttatgtggtctatgagctaagaatggtctttaattcttaaatggcagaaaaaattaaaagaataatatatcgtgacacatgaaaattatataattcaaatttcagtgttcataacattttacagcagagtttgagtagttctgagagtcttatggcccaagaaactgaaaatactatctggctctttatggaaaaagtttaccaacccttgaaaataggtcattgtttctctccttataagataactaaagtgatcaacctaggccttaaagttttgccttcaagataagcctttagtatttcacattcaactccttgaaccctggtaaacctagctgtagttaacaatctagaatgaggttaagaccttgggaaacacagtaagttgttaaaaaaataataggttgatttgagaagctgaataatgttactttcaaattgtacctcgttagtgtttgactatctctgattacaaactcccaatttccacctatttgttttttaaagcacaaaattattctggcacgtctttttaaattgactgcagaaataactcatccagaatgatagaatcgccctttgggactttacccctattttcacttatagtggtagcgttgtcaaaggcactacggtaaaagtaaatgaggaaattaaatgatataggaaaggaaccagtttagttgagcttgaatcttcattttcttttaatagaacttcaaaaatctgattacatggagtatgctgggagacagtactatttgggagacaagtgtcaggttagttccttcttcaagaatcagtaatttttttaagaatgtgctttttgtcatgatatgagttgaacaagacttatttacaaagtactagaaactttttatttatatttttaaagagatagggtctagctctgttgcctaggctggagtgtagtggcatgatcctggctcactgcagcctcgaactcctgggctcaagtgatcctcctttcctcagcctctctagtggctgggactacaggcacataccaccatgcctggctaattttttttatttttatttatttatttatttatttttattttttttttgagacggagtcttgctctgtctcccaggctctggagtgcagtggcatgatctctgctcactgcaagctctgcctcccgggttcatgcctcagcctcccaagtagctgggactacaggcgcctgccaccatgcctaattttttgtatttttagtagagacgtggttccaccgtgttagccaggatggtcttgatctcctgacctcgtgatccacccatctcagcctcccaaagtgctgggattacaggtgtgagccagtgcacctggactatttttattttcttttatagaaacagggtcttactatgttgcccaggctggtctcattcctggcctcaagtgatcctcccaccttggcctcccaatgttgggattacaggcatgagccaccacacccagccgaaaaaaaaaatgtttctttaatgtctgtgttaaattttaattacaaatttagtgattagatgtaaggttctttcagtatgtgctgtctccattgatccagactggcagtgttgatacgaattactttaaaaagtagacactgaactccatttggggaaaagtggtattttgtttggcattagctgtatctgtcactagtcttgagactagaagtattctcttttcaggtttgcttggaatcagaaggaagatattataatgctcatatccaggaagttggaaatgagaacaattcagtaacagtcttcattgaagaattggcggaaaagtaggaatatgataatttgttgaattactgaaatctttggttcctggttccatttcgtaatattaaattgagaattaccaggatgctagtaagagaaccagaattgtatctactgttggcctaggatgacttatcttgaattataaaagcatgtgctgaagtatgaatcaatatagatattagatatgtataaaagttttcaaatcttaagacactagcctacttattagaaatattaagtacaacagaattctgatacaaaactgttcatagtaattgcaaagttgaattaataactgagcctctgccagcatgaagataagctaatctagtctttctcaaactttaccatgcaccagaattacctggagggcttgtgaaaacacaagattagtgagcccagtctctaaagtttctgattcagtaagtctgaggtggggcccatgaattttaattttggacaagtttccaggtgatgataatgctgctggtccactttgagaaccattaaatgaggctgtgctgctctaacaaccaaaacatttcagcagcttaaaacagtaaggtccttcctccttcatttagcatgtccatagtgggtcagcaaatgggatccggttcaacagagattctattttaacacgtgcatccatgatcatagggaataaaatgagaacaaaccacttgctgaatcttaaaatgtctcatactttattaaccagagtggtttacattcccaagcctcatgtcaatggggtggggaaatttaatcctccaaggaggcacagcaaatatttgtgaactaatacagtctaccacagtctttcttctgaaatgtcatcggtactagaaacagcagtgaaattgtacaaactactcttaagttttctaaactaataaaaaattaaacaaggaaactggtgtcaaccaggttttaatagaatacacttgaagtataaggggtgggatacgtgtattgaatgaaagttaagtctgtgttgcagtatcttcatggtgatacctttaacttttaaggcatgttgttccactggctaacttaaaaccagttacccaagtgatgtctgttcctgcctggaatgctatgcccagtcggaaaggaagaggttaccagaaaatgcctgggggttatgtcccggaaataggtttgtatgctaaaggttgttattttgtttttcccttcctgtacctgcttttacttacctgcattgtactattttttaaatgtatgtcatatgtcttgttgtagggtagggtttctcaactttagcattactgataatggaatggatactacttcactgtcgggggtttgtcctgtgcattg

SEQ ID NO: 138593 - DNA, 2580 bp, Homo sapiens
tgcgatcttggctcattgcaacctccacctttcgggctcaagcaattctcctgcctcagccttctgagtagctgggattacaggcgcacgttaccacgcctggctaattcttgcattttcagtagagacggtttcaccatgttaactaggctgtccttgaactcctgacctcaagtgatccacccacctcggccttccaaagtgctgggattacaggcgtgagccaccgtgcctggccatggatgactcagtgttttgatgacctatactaacctgcccatgctggggatagtgccgagatatacccattgatacagaaattacctgctggttttgtccttccaaataaaagatctagtatatccttcaaaaatacaaaaattccctccctatgtttatttggtttgttcctaggggaagcattggaaagtttaaggcagtgtggtggtgacagtacactgggccttttgctttgattatgaagcttatttgctacctctttgtttgcctgaaagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggtaagacattgacagatttgtattttcatggtctagggaaatatgaagcaattgaagagatccaagaagatagaatgccatcaagatgagggtctctgtgacatacagactgtatttcattaataatagttagccctaatgccagtattgcagagagcagagctctttctagttgaatgtttttagaaagacagattagttctatttaactacagagactgactacttaggtattagtgaatagagagttctagtttcctttctctttattcttaggaattcatctcggtttataaacaggcacaacatgccgggccctaaagttgatttttacccaggcccaggtaaaaggtgctgccagagctatgataacttctcttatagatctcggtaagtattgtgttgaaagtcagagaaaattggtaagtctgatttcattgctgaacattaatgttttaaaaagtgtcaactttgagatatttgaactgttatttagaaattaggaacaagttactatatttcatcatttttacttttttattatttgaaccacttaagttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctgtgagtggatcaatgctttactcaaaaagctgtttacttttttcatttatttttttgaagtaaaggcaatgtggataaattttagattttgtacaaataaccaaacaaagccttttctggaaaatgaaaatgagaaaagagacattttctcccagctgttcctagagaagggaatagaggtagacttgataatcttgcctatagagtatgggttaatattttctattttcttgatttttacttcatattttttgtattctaaactgcatggaaaacatttaattacagagttctcttacaatagcagttcacattgttaggctagtttttaaactgccttttaaaacatccctctagcttttttttctgactatatagtgagaactgcagtgtgtgtgtgtctctctgatacagaatcatggaggtccctctacaatggttcctgctacttcaggatactgtgttggaaggcggggacatagctcaggcaaacagactttgaatttagaggagggcaatggccagagtgaaaatggtgagtcaattacagttaaatattttttaaaagattcttgtggcattagcacatcaggccagtgaagtagaccaatttggttttggcgtctctctctgttccagtagcttagttctgaaagatttatataagttcttaatgcttgctgggtttttgaatatgtcctggtatttctcagaagagtagacttctatttcattaggctgctacattgttataacttgttttcagctctctgcataggtctttagtgagttttgacttggtgtcagatatcagtatggaaaacatctattcgttgttagtagggcactattgatagttgtcctcaccatttgtatatgttaggcttttcgtgtgactggctattattttttaagactactatgaagtaactattcgatagttacttcatactatgaagtctatttgatctataaacattactctttattgaaccctacgtgatacccactctactaagtcattatattcataatatagtccttcgtgtgctcttctgaggaatgtgctgtccctattttacatatgaggaaattgagattca

SEQ ID NO: 138594 - DNA, 1007 bp, Homo sapiens
ttttacagtgaagaattgaggcacagagattaaataacttgcctaaagtcatgtagttaatcagaattcaaatctaggcagtcctcactccagagcctatgtgcttaatcaccacactgtagcctcactggaaaaattggacacaactgagttttcacttctgcctgacctctaagagctaagtggattttcagaggagaaatttgtacagcttacagctagtctgtggcttcaatatctgttgactagtgtgaaagctcatatcacttttcaggatgtatgcattttagttttgaacatataaccataaaactggtggaaaaagcaagtgctggccatttggctctgctgagctaaaaagacctatataaacacatttcttctgtcttgtcttttttccccagggcgatatcatgaagaatatctttatcgtgcaggtcagtaagatctagaagtgatctggcattcatcattgtttatagaatttcaagctataaaataatgctcattttttactttggctatattctctagagccagactatgaaacttcaggtgtttatagcacaactgcatctacagcaaacttggtaggtatttaataatagcaaagagttatagctcctactatgtactagggcactgttaagagctatacatataaatgtatttaaatcagaacaaccctgtgaggcttagtatcattctcattttgaagatgaaattgagacagaaattaactcgtgttctggaactaatatatttagagatattctaacataggcagtaatgatcttttagaaggttttattatgatttttttattagaatggatgatacatctcactcaatataacaaaagtttgcttctcctttatgctacatgtctagtagaggtctgtagaagggcttgctcaggtacttaggctgatggaaattcatccacaattgccaaggcaggaaataaaattcggtaaatggtgcactggctcttagagtttccacta

SEQ ID NO: 138595 - DNA, 3703 bp, Homo sapiens
gatagaatgccttttttttttaagcaaaactattgttggtcctatggtgcttcaagcttttaaggcaaagatcactgaaagactgtttagatttcaattatcagttacattttagtatctacatcaggacttgagttagatgtgttgaggatttctgtagatatgtaacaaaacagtcacctacatcacattttagagtgataacttttagagctttgtcttaggagtcacttccaaatttgaattttttcaggactgatcactttcatatagttttaaaatatgttgaaacaaagttattgatgtgttgtttgtttttttatttaactatatttttgtattaaagtctcttcaggacagaaagtcatgttctatgtctcctcaggacacagttacctcatacaactacccccagaaggtaatcctcatagtgttattaagcagttacaatggcctgaacacagaaaaatgaatttcctcttttcatttaccttcatcatacttcaaagcaactgcttttgttcctttaggtattattgtaccttctggtgtctgacacagtgattagtaaattaattcaacaaattattgagcatctactgtgttccagacactgttctatgtgctggctttagattactcatagtctcctgtgagcctcttttatataaagagtgagttaatctaaattacccatcaattctgtctcattaactgaaacttaattttaaagctttcctgtagaatggagagtcagcattataaaaaggtagctgaaaccataggagtaaacaagatcatcctgggcaaaggaagagattgagaagggcatctagaacagagcccatggattatcaaattttagaaaatgggcagagaaggaccatccaagagggaggaaaagcacgagagaggaatattatggaagccctaggaagagaatgtttcaaggagcagccaggtgtcagttgctgccaagaggtcaagcaacataagacttaacaaaagtctactaagatttgttgacatagagaccactggtgactttgaatacagtttcagagaaccagtgtgggtagcagccacactgcagttgggtgggaagaaaatggagactcccagtgaggacagtatgttcaagaagaatctgttaccatttactgaatatctttctgtgcacagccctgtactgggtgctgtggaaaaatagtttattctcttaaggagctgtggcctaagcagaaaaaaaaaaatacagtcttacaatgttataaaaaatgcaaggcaccttttctctttaaaaaagagaaaagtgtaggccagatgcagtggctcatgcctgtaatcccaacactttgggatgctaaggcgggcaggttacttgagcccaggggttcaacaccagccttggcaacatgacaaaactgtctctactaaaaatataaaaaattagctgtgcgtggtggtgcgtgactgtagtcctaagctactcaggaggctgaggtgggagaatcacttgagcctggaaagttgaggctacagtgaatgaaatcatgccacttcactccagcctgggcgatgggagtgagaccctgtctcaaagaaaggtgtttgcttgtgtggggcaatatatatgcatgtaaaaatgaattacaaacctttggaataatatgcaggaagcccagaggttaactgtttggggagcgggcaactaggcagacaggacagggcttggagggaaactttccattgtatacgatttaatacttgattttcaaatcatattaatgtattacctttttagaaataaatgaattaaaaaattaaagctctcaagtgacctaagatcttctgaaagaaataaccttcctatataaggtttacataaagattgactttcagtgttttagttttctaaactaattactattttctgaagtttaggatcagataatctactgtttgaaaaaccaaacttaagagttttgaactttcttccacacttacagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccaggtaggttattagcagatgcttactttggaagcctcttttcctattcatgaacatgcacatccagctgttctggtaattacataccattactttaatttccagaattaaatttatttaacctacttaattatgttctgccattgaggaatccatgagatttgagagtcagggattcaagtttattcttgaaaatttcgtgctggtaagattttatacctttcattttgctacctgctgaattaggggacttgtactagtttctcaaactttgagttaagttttatcatataagagtgaagatagcgatgcttctcaccttatagcaaacttttcaggaatttattctataaaacacgttcctttgtaatgaataattgtcctgtaaatatcataataaaagatacaggctctggaatttaaaagatctgggttagaatcctggttttacaacttattgtgtaattttgcacaaattattgaagctttttatctgtggcttgggggcactgatagtaccaattcatgaagtggttgtggacttttcagtaagttaataaaattttaaattatcagcagacttctaggaaggtggtggcaacaacagcattagcttttctgagtctcaaaataaaaatggaaatagtgaagtcaaaacccatgacacctacaaaaatctaggtgacaaggtatccccatgaaccccaggatttaagcaggtagggacaaaccactagtcacaagacctgcatgctatcagggtctatgagggagcaagaacatagaagcattgaggatgttgtcttatgtacctgagaattccaatgaataagaattcactgaaaagtagggcagacaatttggaagcagcagccaaaactgggaagggatttggtctctctaatactaggtgagtgcatgaggcacatagtagaaggacttgaagggcttagaacagtttaacctctaactcttcaaaattgacctgccagagttcccttttaggacagtattcctcactgggaagaaactgctaagagtggaatctgaattgatcaggatagagaaaagagcaggtcagggaaaagaacaaaagaaaaggattaaggtcaaatgctacacaaatatatcttaaggaataaaaagcagaatatccctacagacaatgaaaacatgttagaaatgaaacactaaacagatctaaataaactaaaaactgtgacaaactatttcaaaatgagctaaagatattaataatacaaaacattaaagaataacataaatcagaattagaaaaactcacctgaggtgatagaactcaggaaagaattataaaggggagaaggtcattttagtaatggagactaaactgtaatgagcttgagcaaatacaggttgagtattctttattcaaagtgcttgggaccagaagtgttttggacttaggatttttttagattttggaatatttgcattatgcttgttgagcattcctaatctgaaaatccaaaattctccaataagcatttcc

SEQ ID NO: 138596 - DNA, 1948 bp, Homo sapiens
agtttgaatttcagattttcaaattagggatacccactctgtatgtacagcagataatgctttaagagaaataagagtgctttaggctttaaattttttttgtttgagacggggtattgctctgtcaccaaggctggagtgcagtgacatgatcatggctcactgcagcctggatctccaggtttcaagcagtcctgctgcctcagccccccagtacctgggactataggcacacgccaccacactcggctaattactgtgtttttgtagagacagggtcttgccatgttgcccaagctggtcttgaactcctaggcttaagtgatccacccacctcagcctcccaaagtgctgggattacaggcatgagccaccacacccggccataaactttagaaaaaaaaaaaaatgtaagaagagggaaatctaaaattgaaaaaaaaaaatgaagataaagatttaaaagcgacatatttgaagttaggcaaatgagatcaaacacagaagtctctgaaaaaaccaaagtaaaggaacaaaataatactaaaagctataatttagaaaactttgctgaagttttgtattaggttgttttcacactgctataaagaaatgcctgagactgggtaatatataaaagaaagaggtttaatttactcacagttctgcatggctgaggaggcctcaggaaacttgcaatcatggcggaaagtgaagggaaagcagacaccttctttacaaggcaccaggagagagagaaagaccaggagaaactgccatttataaaactatcagatctcatgagaatttactcactatcacaagaacagcataggggaaaccgctcccatgatccagccacctcccaccaggtctgtcccttgacacctggggattacaactcagtttacaattcaagatgagatttgggtggggacagagtcaaaccataagtttaaaaagttttaaaagtacatacttgaaacagcaccctgaatacctgagaatattgacccagagcaataaacagcagaatattctaataaagttgctagagttaaaaagtcctaagtatctaagagtctatggcatataagagaaatacaatgataatcatcaaactttgacagcattgctttatgctagaagacagtggaataacatttaagatactcaaggaaagaatatgtgaaccagcaattttgtatccagtcaaactgattttcaagcacaaagggcaacatgtgagaaaccaagaatattcttcccatgagcccttcctgatgaatctgtgagaactgtgctgtcaagcagggtaatcactagccacgtgtggaaactaaattaattacagttaaatagagtaaatctgtagttcctcagttgcattagccacatgtggctagtagctactgtattggacagcagagatatagaatatttctatcatcacaaaaagttgtattggacaacagtgtactagagaatgaactttgagttttaggctaccagaacaattagagacattgttctggtattgtgtaccagaacaattagaggcagaacaattagagacataagacgtgatggtaagtattaaatacatagttacctgtagaagtaagacaaatgagggctgagaagttgagactatactatgtaatagccttatgtttggagggtgtagatgtagttatttttttaaatgatagaattgagagaatatgggcaaagcattttttcatgctctcagtcacatcagattctttagtttagatgctcagaaagttattccgagactatgtaatgtgggctaaagcaaatgagtaatggtgggatattctaattttatcccgtgtccttgtgaaccaggattcttagtgtggaaaaaaggtaatgcagatgttatagaggttaattaaaagcttttatagtcttgaacttgaat

SEQ ID NO: 138597 - DNA, 1049 bp, Homo sapiens
cttctgaagtgtcctgaagcagactacagctacatggatgggggaaatcagcattctgaatgcattacgttgatttctactagtattttagaagacgtttctataattcttgagacatcccttgaagtgtatctgttaagcctgtggagctcttcttaagtctgaggatgagaagctcatgcatctctatagaaacttgaaattgtaaaagcttttacttagagggtttattgtaatactgtgcatttataaggaaggtgaattcagacaaagtaacctccaaattgtgtctactcttgattctttcaggcccgtgagaatgtatttagccacttctatgtcttggtttttacctagtgatcataatcacattctactatcttcagctaattgcctttctccatttgcttttttttaaaaaaatggcatgatacgttttcagtgctagtttaaaaggaataagagcagagctttgttggaggagccattttatttaaaaaaaatctgtatctagaacatttggggatattctgaaaattaagttcccctcccaaaactgtaaaagtagagatttcgaaatatatgacaaaactccaaaacagctagttgagcaagctttaaaaacttactgtttaatttagatacagtataattcatttttttggtgcccagttctgtgagctttgacaaatgcgtagagttgtgtaaccaccaccacaatcaagagataattgcatcactcctaaacagttgtttatcaagttttacatcacctgaagacacagacctattactgttagcctgtaaatgtacaaaagataagatgagtatattgttagtactggtcactaaatggaaacaatgtggattatgtcttgctaaaatatcagaataacaaattcagcttgtgtgaattgttcctatgctcctatgctaaactcagtgtgctaaaactctgactttaaacatttatagaatgataagactaaactttctatgtttctcagggttaaaatgataatgcagataacaaaatgatgaaattttgt

SEQ ID NO: 138598 - DNA, 2034 bp, Homo sapiens
tcttatgtcaaaaacttttaaatattgattatttctaagctatagtaacaggtatagaaagctaaagggataagatattgtatctaacctgtttttagattctgtacctccttagaaatggaacgttcatgatttaaagttccctatattcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagtcaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaaggtaagtagattttgagacttaggtgagggatctgagacttaaaaaatattgttagagcatatctctctttggttgacctattggggaatggggaaccaaatgaaaattgacttgagaacacaatactggaagtgactaaggaaaggagcaattaaaagctgaaaactgagaatatcttctacataatcaacaagtggatggttgagttgacgtgtgctgctgttttgttttgttttgttttgttttggtagctacatgtctaccctgaagaagattctcaaatgaatatctttgcttttcttaactgtttttccttgcaaaacaggacttggtatcaaatttttctttatttcttaaattctttccataagtgcatgaattattgcagtcttttatatttagaatttcaactgaattttaaagatttgggggagtggggattaggagtcttatctgccttgaatttcagctgtgttttcttaaacatctaaggagagtagtttttcattggaagttctttattactcagtttggcatatttctcaagagaattatagttgagaattgtttgtagcttatactttcttgctataatattttcttggtttttctagctgcttctctatttttgcttttttttttccaacccctaatcaccaagattttctttaactcccttctgttttttccctacctttaaacttccctgttacttctgtgtagtttattcctaaatgtagctagccttggcatcagaagttttagtttcttgtctccagatacttgctagacattttcacttagctttttagttttcatttcaataatgaaattcctcatatttatcttttccccagaccacacaaaacattgacttttctccttggttttttattttgttaatagtggtatcatttccacctaattttcccaatatctaaaccctgatttctttactactctcccttcccttacctacctgtacccgagatgtacttagtcaccacataatgctgattttgtatttttccaatattttactatgacaatattcaaacattcatccaagttgaattttaaaatgaagtcatatctatcacttagattctatcattaacatttatactttatcacatatctatccatcttcccctccatccatctctatt

SEQ ID NO: 138599 - DNA, 1049 bp, Homo sapiens
tattatactcttaaaagactacagtatagtgtataagcataactttttttttttttttttttttgcaacggagtcttgctctgttgccaggctgaagtgcagtggcgcgagctcagctcacagaaacctccacctcccaggttcaagtgattctcctgcctcagcctcccgggtagctgggattacaggcacgtgccaccacacctggctaatttttgtatttttagtagagacggggtttcaccatgttggccagaatggtctcgatctcctgacctcatgatccatccaccttggcctcccaaagtgctggcattacaggcctgggccaccacgcccggccataagcataacgcccagtacataagcatatttactgggaaaccaaaaaattggtgtgactcacttccttgcaatattggctttatttttttctggaaccaaagccatgatatctccaaagtatgtctgtatcatattttatctattagttgaggaacatttgggttgcttttactttctggctattaatactgctacgtgcgtttgtgtatacaagttatttgatacatacatgtatcaagtagaatcccatgccactcatgaatttatttcctactatttttttaaaatattatgtagcttgagcattaggctttatgctgtgctcctatataatagtcaaaatacaagctgattttaaaaaaaaatggcaataaatgtatttgtatgtgtagggagtctccaacttaaagagggattttctaaaagttcatctgttagtggaactcaggttatattactttataaataaaaatatgtgtggatctcaggtcaaacaataaaaatacatttagaggtccaattggaatgctaagaacagtttttgttcatttatgaaatagtttagtttcataacgtcaagagaaattaccttgctcattgcccttctctttggagttctggtggtggtatgtcagtcatggtaaataaaaacaggatgaattgtttcatattgttctaattgtctcagcaggcatcactaatct

SEQ ID NO: 138600 - DNA, 1022 bp, Homo sapiens
tttttaaatcttttaacaatacaagcattttttctttaaatatttgacagcatgattttcgttgcctgtatagtatttcattacgggtatataatttatccagttccctgttgttaaatactatgtgcaatgttttttgcttttaaaaatactataaaagacacctttgtatacaggtcttttagattatttcctaaaagaattcttaggtttaaatatgagatacaaatgctgcaaaagatcctaaagttctaatagagaacagactgtcaagtttttaggtcaaaaaagtcattgctacctcacctgaaaatcgtggcccaattcttattttttttttttttttgtctgtggggaactgtattacattaagaatagagaagagtgaagtttcttatttttttgttgccctttcttgctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatggtgagtgtgtaatgagattgccagcaagaaagacagttggattttattgtgtgtaattcaataatagctttcatatatttcatcaggtccatgtactacaccagtgattctcaaagcatgatatgtggacctcttgtggtccctaagactctttcaagggattcatgaggtcagaagtgttcacaataatactaagagtttatttgcccctttcactggcttgcattttcattgaggacatagaaaccagtggtgggtaaaactgctgacacctaagcactagttggtactgaccccagactctgctagtaatcagtgtttttctcactgccacacacccatggtacaaaaatgccaatcttatgtttttttgtttaatcaaagacatttttactaaatttttatccttgaatagttgtattt

SEQ ID NO: 138601 - DNA, 1489 bp, Homo sapiens
gaaattaaaatgtgatcttaatgacattcaggagatgacacttttagggtgttcttcagagctatactttcaggtatagaccagaatgtctagacacctgagtttttcattgctaaatggttattcggatgatgtatactgtaaaactattggataactcaattgtgaccacctcttacaagaatttaattaactagaaggactctaaagaatatttatgtatttagcttgctgatacctaaatcatcccagaaagatagctgtctgtacattgaatagatttgacacatatatttcacagttttttaatttggaaattttcatattatctttactcattatttgtatttaaagtgctcctgctgcaattgctgtgatctttcttatagttagttttattttcacacataagaacatccatttatgttgcatggggttctgttttggtgaatttttgtatataaagtagactgtatacatcctttctttcagatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgccaaaacgagtgggattttttctttttgcattttcatgtcagcaaagagtaccggacatttgattgtttcaacatgttttttctctg

SEQ ID NO: 138602 - DNA, 1043 bp, Homo sapiens
caacaaggcttgtttgtattcttgccctctctgagcacacattccttccttctgggtgtgggacaggatcctctctggaatagggggtcttatgacagtcaaaccaggtaaatcagatagttttttatgaccagtttttacacagaaaggtggagtaatatctttaggttttagaaaagttagagtaatatttttaggttttatggctggctttcaggaaaaaggggttctggtttctatgacccaccttggggaagagggattctagtttctatggctagctttggggaagaaggagactgagagataggagggcaggagaaggtcagagaaaaacttgctactgaggccttcattcgggggtattgttttctgagtccagacattgtcacatcttaccatttttgtttttagacttaatcttgtatctctgaaggcctggcttggctttggctttggctttggcttgctgtgagacacatttcatcatccttttttgccttctccctttcatctatctgaagaccacaagatgttctgtattgatcagttcttctctgaggggcaaatcgtcctgaatgctttgctctgtctcacctgacaaacagctatttaaaaagtgttctttggttgccacaaaacctatttatatcgctttcttaaaaggttatttttgtgactcagtctctcctttccccctgtggctacaccttggccaaaaagaataatttgagacatcagggcttgaagtacttgaacagttgaaggtactggagtggaacattgcaaagaagatacatcttcaatgtactgttctcaagatgattgatattgatgagttctaaataagccaatgtactaaaggtttctgcttcataatagacagtaccgattggatttgtttttgtatccttgattttaagaaggccttgcactgtgagttagcatctgacaacttaaggtggatggtagtgcactaatgttttaataacaaccaactgtgtgtactagtgttttaacttctctgctaacctcctgggttc

SEQ ID NO: 138603 - DNA, 1064 bp, Homo sapiens
ctctgcttttaaccaaatttcagccatttagaattgtttggggaaggaaatacaaaggcactgtaatttgtttggaaccctttacttacagccccttcttgacataaatctggttacgctaaaggtaaaaagctggataatttctcatagccaggaaaaataattaaattcatttttatgctgtatatattctcaaaactgattgtggctttctgccttgattaagagcagatgaaaacattgagtcggttttactgttgaaatttaagacttatgaatttaaaacagctttcatttccttaaagcttataatcaaggcataacctttcaattagctttggatttaaaaggataaacaaatcatgggattttttatgtgaacaccagacattcagaacttagacaaatctccatagataatgaatgatatagtctattgggaagggtggagcataaacttaatctagacttttgtaaatctgggccaaatttagttcatttcatatgaaacctctttaaggccttttatatttacgtttataataaagaatttatataatttatataagaattcaagagaactaatacaggttgagcatccctaatctgaaaatccaaaatgctgcaaaatctgaaacttcttgagcactgacttgctgctcaaaatgttctttgtggcaatttggaatttcgaattaggaatgctcaaccagtaaatataaagcaaatattctcaaacctgaaaaattttgaaattccaaacacttctggtcccaaacatttcagaaaagggatactcaacctatgtagcaagagacaacctcttgtttccctccatcctacctagaatgttaagtttcagtaggagcaacttgatttagaacacttgtcttctctcctacctcaatgaccaaaggcagttttccctaaaatgcttttcagggacatggagggtgcctgtgtgtgggagatgtagcttcaggaaaggattgacctgagtttaggtaatgacctactgtgtgactaaaactgctttagagtgattatgggaagtgcttcaaagt

SEQ ID NO: 138604 - DNA, 1972 bp, Homo sapiens
aaatatattggactgtggaggtctcccattagtgtttctgctaggcaaattacattgtgaagtcttttgttcataaatgttaataataggtggctacgaatgattacactgaaaaagggaggaacataacaccttaaaatctgagttgtcacacatttcaggggaaaaaagtaaatactttattttgttgatactgaagctaaaaatacacaaaattattttattgtacaagattctttttaatacattaagattgacactgtgcacttacagaaagtgtttaaataaaagtgatagttattcaaagagatttccactttgaaaatagtcttcaaagccagtgtcatttacacagacacatttggaattttcccttttcatgattatgctcaagatgtatcattttaaactgaaatttgacacactttctatatggtgatatgtggttggggctgccaactaggcttagaaggtgaattacacatagctcgtattctctagtattctccttcctgctaccaaatgttagtttgtagctgcagactgcattcattgttttgagtagaaagaaactcccatccctaatttcaaccccatttttgagaaatatggaataaatagaatcctgtgaagagtttaactattgttctgttgaatagtacctctggtgtgcattcctattataagaaacaaactaaaatgtatttgcttgagaaggatgtgtttatccttatctgaagtgtcctggggaaggtctgtgtctttactgttgagataagatacagctttacttttactttgttaaggtagtaatttgaacacttaattttaaagttaatttatcgaattgaatttccttttacattaaaccacagactaatgtgttaaccctttgggtttagaggactcttcatgtgctcacataatattcattttggtgtcattggtcccacttatcctgttaagacacttgagaattctggctgcttctcctgcccacgtacactaagcacagttatcactgatttattggactacaggttactttgccttggatatttaaactgattgcttaatatgttttacaaggaggtcctacaaggtgtggccacaacatgatgaggctatactttaaataccatgactagatcttatacaggaaatacttaatctgaatatgtgactttcaaatgacctgaacacattcagctagctagctgccatcttcctattagagtttctttccattgcttctgccaccgtgggttcttatgagtccaaaatcctcccctctgttctctatggaggttagtggtttttctttactgtccctctccctgataacagcctagtcaccagagcctctgtgctatacaatgtcatttcttaaggatcaaataagtttgaggagtcaattctgagtttatttacagcataagccattggaactcaatgtattttactgtttaaacacaaagggttaatcattatggttgttcccaaatcagtgaagcttctctatctaaatatattgctctttaaagtgttctcttcaggaggctatgtgcttattcatgtaaggctaccactgctccaagcataattgaaactagattccaggatacaaaggagaacaagcattcttgagggggtgatggagatattctataacttgattttggctggtgcttccaggggtatatacaactctgaaaactcaccaatttgtacactttaaatgaatgcaggtaattgtacataaatcattcctcaataaagttaattaggggaaaaaaactagattcccaagaacagttccaggtcccttacaaatcccacaagagacaatctcattattttataattgcacctatcaaagtgcctattgtgtagtagcacttgaaaatgttttttgtttgttcgtttgtttgtttttaaccagagaaagtggtactcatcttgactaccacat

SEQ ID NO: 138605 - DNA, 1096 bp, Homo sapiens
ggggagaaattgatttgagtaaataaccacttcagatatgatcaaggaattattttcggacaacctcttgccaaatgggtcttgatgcagctttttcacttgatcactttttcctggatatgaggctttattcttcaaaacctcctcctatttctggcccctccccctccattttgctcttctccaggctagagacaaagatgggaatccattcaaataacagaaaccacacttatcaaaagctagtttggaggcatatttgcagttcgaaagttcctcatttctcttacttttatcagaaattacatacattaatctaaatggattcctattggtgttgacattaaaaaaaacagcgtgacacctattttacttttctgggctacacactatttatgtaatctctaggactcagacctagagttgtttcaggtcatatgttagagtctaaactgaggaaacctttgtgctaatgttggtaaaagccgtccttgctcagcaggttctcagtggttatcaggtctagaatgatgaccatatgcattatggactttattttttaacttgaaccactgtattctgatgaggtactcttaagctgtggaaaagaatttgtttggatgtataaatgtagctttcttggaagacagtagaatttggatcacgtttataattccatgaatccactagggttgttatgatatatatctaacataatttacacatgcaattccactgcccccaatgaatattaaaactgcaacctgaattaggttatctatacctaaagttgccatttttataaagcagttaattaaaatgaagatgctcttttctcatattttgacacttcagcaatatgccatttttctgataaaaatatttcaaattcaggcttttatcttagaaattatttgatagcaatgataattaaaactatcaacagtagaataggacccaacaaatatgacaactatttatcttgccaatgtatgagatgtagtgactattggttagagtgtagtagatgtttttaaaaaatagcacaaattctaaatactaattttgatactatcaaattttcaaatgtagtaag

SEQ ID NO: 138606 - DNA, 1078 bp, Homo sapiens
agatggtgcaaataagagtttcactctcctttctggggggcaggggcagtgagggaatcatattctgtgtcacctctgagagcaaggaaattacagatttctgttgagttccagaacagatgattagggcttgacttagaggcgagttgtaacttgttcttcctgtccatcaccccatttgtgcatgagcaagtcacaagcctctccccaagtttcaaatacatcctctgaggagtctaaaagtttagaatttgaggagcagatgctggatgcacagtgaagagagctggaacaggctagagggcattcactgctctgagcagcgccctggacttcacctaattctacctcactgaggttaatttcactttgagaacaggcctctgctttccctttctccatctgagaatatctgatgtcctgccacatacagtgctgctgaacaattccatcagaaattgtgtacattggctctgaactgggttcagacatatgaccattaaatttggagaataggagacccagtttcttgagagaaggacccatgaaggagcgtttgcttgatgactcagcttttgactttccttgggcaccactggaccttggcatggttctgatgagaggtggcccatggcaagtctttttcttgcagcctaaattaaaagagacactcttggatttggcccgagccccaccactgccatcattattatcgtctctctgagacagttcagtgctgctagtggaaaagctccttggatgttttctatttcccaagaggtcaagcacttcataccgaaagctggagatgtcttgctttaattcctgggaaaagagaggagacatattatgtcaagaagcttggtctttatttcaaagtaggcacattagatacctttggtatgttccaggtttttgcctagtagcaaatcacaaaacaccagaaaaatctgccattattcaaacacaagaaaaacatattaataattccatgggcagggctgggctggccattggcaaaattgtacaatgggtaaagttgattcaggattagctaacactttagcagggattagtc

SEQ ID NO: 138607 - DNA, 1891 bp, Homo sapiens
ccttctcaaaacttgttactaacttgtcactgactttaggaaaaagtagaaatgccataccatggactacaaggtttttcaaggcctagtacatgttgctttctccagtttcatctttctactcttttcctaggctctctgctgtccacctgtatggacatattctcccttgcctctgggcctttgcctatgctgttctctctgtctagaacattcttctccccaactcgcccttatctggctggctttgctttcaagcctcagcttaagcatcacttccattggaaagtctgtcttgactccccaagtcccagatgagcgtccctcctctctgtgtttccacagtgtcctgtgtttaacctgtcagaatataaaattgttcatcaccctttattattgtttgtcactccttgagagtaggagctggttagatcttgctcaccactgtaccagagcacttagcagagtgcttggaacatagcagaccctcagtagatgaattatgtctatgaattaggataatggactttctgtgtgccttagaaaatatagatgtgttcatggacactgggaggggaacatcacacacaggggcctgtcaggtggtgggggttaggggagggatagcattaggagaaatacctaatgtagatgatgggttgatgggtgcagcaaaccaccacggcacatgtatacctatgtaacaaacttgcatgttctgcacatgtatcccagaacttaaagtataataaaaaaattaaaaaatatatatatagatgtgttctaggataggatttctcaatcttggcactattgacatgttggactggataattcttgttgtgggagactgtactattcattgtaggatgcttagtagcaaccttgtctttactgtctagataccagtgtgacaaccaaaaatatctccagacattgccaaatgtggtcttggggacaaaattgcccctggttgaaaacggttgttttaggctaatgccactagtataattttaatgtttaatggtagagtttcttaagaccttagatttaataacagattttttgatcttatatcttttaagtaaagaagataattaagtctgcaggcatcttccctttgttatcttgtccctcaccaccatgcatccttgccacatcatttaaagcattcaatttccacactgagaaacactcagaatattaaaagaatgcatacagcagatttccttcattcctgacactgattgtggtgtgacatacattggtaaaatctctccgtctactggatgagagacaattctaagagaataagcattataactggctttgctatattgtaagcagatgaaattccatcaccagaaacctcacacactgtgaagattaaatgatgcttatgatatgtaaaatgaaaaaccacttcatgattaaattaccttaaaattttcttctgtaagtccctcatgtgttttggaatttcttatcatagcagccacatatcttttgactaaattcctgataacttcctggaattacaaaacatgaagaagcattcagtctccttctcaggctctcagtacagtaagaaacttacataggaaataaaacatgcttagaccttctttgcagtagaaaatcctcataggatccagccttttattgtaaaaatgagttaagtccattggctaaacaactattgtgtctctgaatttagtggcagaatcaaattaaccctaaaggaaaattttttacccaagcataaggtaaacatgtatttccagtggaataattcttgcatggtcatatagttaatatccttttcctttaggatggattacacgttaacactcatagtaaaacgagagttttattctccttttataaaatt

SEQ ID NO: 138608 - DNA, 1166 bp, Homo sapiens
gtaattttaatgacgtgttattttatccctgctagataatatatttcataagggcagaaagattgcatcttttttgttcatagtgatttttctagtatctagtgtagtattttatgtacagtaggtactctcatatttgactgactgaccaaccatatattctattttatgtaacttcaaggaagacagctttctaagtcatagttgttgctgatcaagccgaggcagtgcataagggccatgaacaggattataaagcaggtgattccacttggagaaggtacttcagcccttgataaattacagcctttccaagcctcctatcccagtcaaatgggatcgtgtccagacacagccagagtgaagtttgcttctcctccacagaaccagccaacaactattgtgcttcatccctgtgaggaagctttacctgataatgttgattttgtatcaggctgtcagcattgcgttcctataattgaaaatagacagagatgttacatcagcagtctcccagcaccctacccacccaaacatctgaatataattatttctatatattaggactagagaatgctacaggagctcctgcctgacaaatccccaaagcaaatgtatgttggaatgattttatgatgtttaaaacagtgagttggtcacaaaggagggacgggaggaaacagttttgtttaaaaagattcataatattggccaggtgcggtggctcatgcctgcaatcccagcactttgggaggccaaggcaggaggatcacgaggtcaggagttcaagaccagcctggccaacatagtgaaaccctgtctctactaaaaatacaaaaatgtgcccagcatggtggtgctcgtctgtaatcccagctacttgggaggctgaggcaggagaatcacttgaacctgggaggcagaggtggcagtgagctgacatggtgccactgcactccagcctggatgacagagcgagacgccatctcaaaaagtaataaatacaaaaaattagccaggtgtggtggcagacgcctgtaatcccagctactggggaggctgaggcatgagaattgcttgaacccaggcagcagaggttggcagtgacccgagaccgtgccactgcactccagcctgggtgacagagtgagactccatctcaattt

SEQ ID NO: 138609 - DNA, 1059 bp, Homo sapiens
aggcaactttttgtgtgtgtgcatagaatgctttctggtgcccctcattgcacccactccactgatatgaggatatgattttagctaagcattttgaaaagagcttgaggaccccaattgctcccattcctctggtgctcacgtgacctcacgttgggaattattatgcaataatttagcagagaaattattataaatactcttctaaacagtctttttccattcatttatcatgtatcaattcattatctaactatccatttatttttttgattcctgtgttgagcaactcccacattgcaagtgttctgtatagttctgggtataaagagatgattgtccagtggcggtgatgggaatgccacacagaatacaattggagtacagcggtattacctgaatcctaaagatcagcaactatagcccacctggaaggattggataaacacagtaagctgctaattgttgagtaaggtaagcattcatacattaattcattcaaaaatatgtgttgattgtctgccagatgctaggtggtgggattatagcagtgaataatatggatgacaaaatcacttggtatatagaaatctgttttatttataacccttgatttaaactgaattataacattatggatgtgcttttgtaatcatacttatctaaaactttccaagagatatcatccccaataaattttcatttattttcgtgggactagcctttcaccttatctgatagacaaattggacattggctgttcccttgtttactttcagtgtttggtagtgatgcccttttctactatctgtcctaccctctctacccaactatgactttggaacattttcccagatcagctcctggctgggtggttttgtgtaagagacaaactacaccaccatagacagtggtcctgccttttctccactttccacagtgtttaggacttttgtgcggctataatgtgcacctaacgacacatagccttacagatgtgttctaattcatgtgtgtgccctgcattgcctttcagattgtcagctcctgtagagcagg

SEQ ID NO: 138610 - DNA, 1042 bp, Homo sapiens
gggtttttgctgaaagcaagctcaaagtggatcagtagagtgacagagttggccagatactccagtcatcctgggggggcagggtgggcagaagcagaagtagattatctataattaaagacaagattactcttaggcccatgtatgttgctgcaaatggcttgcacataaaactggtgaaatctgaatgaggccactggattttatcagtgttgatttcctggttgtgataatgtactacagctatgcaagatgttatgcctgggaaaaatgggtgaaggatttacagatttctttctctattatttcttccgattacaatgtaactacaattatctccaaataaaaagcttaaaaagataggattgcttttggacgtcatctttgtcttttcactcaattgttcagtagccatgttgagcacctttatatcttaggcccctctatggcagatgcaaagcttactaagatgggagtctcagtctggtgggagagagaggcacagatgtctgaaatacaacagtttatgtaacataatggagatgtgtttagaatgccatgggaaacatgcattctagaagaagcctgcagctgagagtggggttagagtggataagaaaggctttagagcaggtagccctttggcagcagttggaaagatgggtatgagtttgccaggctggctaggtgaggatgggtattccattcagaggtaatggcatgcgatgtacaaaggtctgaagggctgagacactttcctgtagttggagaacagcaaaatgttgacaaaggaggagagcagtaaaagactggagaggcaagagtcagattaccaaggccctgtgtgttatggtaaaggggcaggattttatggagaagattcagatattctggcaggcatgaagccagtgggagccaggatgcaacaggtatttagaaagaaacttccgcacagcaagtaggagagtgtttggagagaagaccagattggaggcagagagaccagtcaagagtctgttgccacagtccttgggagaaatga

SEQ ID NO: 138611 - DNA, 1376 bp, Homo sapiens
aagctgctgttatacactcctggttggcttaaccaaaatagcactatctctttgtcaacccattttggaccccttctccttgcacattaatctggtttccacacccaagatttagccctgagtttcaggaagagagacaaggagcatggcctagtgcaggaggtttaatcatagattccattctcctgtctattaacatgccactgagctgtggtttgtgagaatccattttaggaaatgctgctagagacaaataacaagaatcagctagatagcactgttttgttttgttttgttttgtttttttctctatcactgcaacagtcctttttttctctggcctttgttatggagcacatttctagaatgtccaagtccactgaactgtgttggtttatggcgttataaggaaaaaattgtatcttagtttaatgactaagaatcttgtatgatcttggggtcattgctatgaatatccagtgatgagttgcactctcccgaagtaggggtggagatggacaagatgtagaacactgagttcagggtcagcccaggacagctcctaacagcctgacatgtacttatttgttttctcttgtctatttcccctggcattgatttatcagaaaataaaagccgttctgaaggcttgaaggtcccccaaaaagtaggtcttgacagtactaagcaaaggcacaggagttccatgtgttcagaggcagtggactcgtggacagaatcatgagttatctcttgtgtcctgagacatttccaattagtgctgggtgacacttggcccacctgaaaccttaaattaatgtaacaggagagtggattctagtcctaccttcagcctgtcccctctcgagattacacctatgaatgggggtgcattaagatatgtttgcatccttccttgattcacaatagtaaagttagctttggtagccactcgttcagaggaatagctttgctgtttcattaccttggtgccacatttcgagtgaggaattatctacctcaccccaattaattcttttaaaaatatgtaatgctaccaacatagttcagaaccaactctttagatgacttcctgggatctcatgtgtgtgcttgtttctttcctacctcacctaacttcacttcatcccctagtaccctgtagcaagagaagaacattcctccacctctgacccttcgggtggatccacagtgagcactgccttcacagtcaagtggcagtgatgaagctgtaggctgaaaacaggacaaaaatggagaaggcggaaaaaatggcaaaaaaaaaaataaataaataaaggaaaggggatcgtcttacgtggagaaggcattgttctgtttctcacatcggatcc

SEQ ID NO: 138612 - DNA, 1030 bp, Homo sapiens
ttacttgaggcctgtcctgactgatacttggctttgtctctagactaactgacagacagcttctctgtccttgaagatattaagttagcaaaagcaagccctaggtgtactgccaatctcaccatggaccagtgcccgggacagaaggaactacatttctgagactctcaacaaaggactaccacactgcatgggggtggggtgggggtgccctagttcagagctagtctgactgcctgttctagtagtttatttaaacaggaccatcaggcagtctggccataggtcctggtccctttgacttacctagaacccaaggcaatatcatccattccacgacagttgggggaggcccctgtacatgaaggtctgtcctgacaatgtgctgagaagccaggagaagcataaagaggaaggtcaaataggatgctgtgtggcagataaacttgataaagggtttcttgatgaacagcccaaggttgctcctgggtgagatcaggtaggctatagacagcatgggaaacaggaacccaatggtcatgcaggttagaagcttgactacccagtgtttccgccgccatccagggaagccatcataccacagggtggcaagcaactgttggcagttgggctgagcaacaaactgggaaaagaagaaaacaagttaggcatctggaatgtccaggagaaagtctactgtcataatacctttcctagtttacagtcagctctggcaaggagttacatggccaatccccagaagaggcctgttttctaggtgcctgtgaatgcatctaaccccggagacggctcttcatgtcaaactatgaaactagattttccttagtgttcattattttttaatatattaaaacaaaatcactctgtctggttcatgctttggcataccttcctattgtccctcccaccttgtcagagttgtgcttcctcaaacctggttttacatcagaatcatccagggaacattaaaaaatctaaatccccaggtccttccacagactgactaaat

SEQ ID NO: 138613 - DNA, 1015 bp, Homo sapiens
ctcagcctgcagaactgtgagctaaataaacctctattctttataaataacccagtctcagctattttttattagcaacacagaatgaactagaatacctagttcatgcctagacagagtttgcatgcatcagcactgtttccattatttgttcctctgaatgttttgagggtatgttctgtcatgccaattactggcttagaattctggaaaggagactgatagtggtggtagtaggcggtagggatggtgaggtaggggaggaataacgtgttggagaaatacatccaattgcagtcagtatggtcctcattgtatagtcagatcctacaaataagtctaacaaattccagagtgaacaaactgaattgttatacaagacacattttagagggttggagacaacttggtagataaaagagagaatttttcattgagaaagattggcaagtcaggattgcaggaggtatggctttttcagggctgactgacaagttgaggtatcttagggtatttttcaaagctgagatggaagattgcctaagcatggttttgattcaaagcaaaaagcttaccttcagaggacatgaacagacacttctcaaaagaaaacatacaagtggccaataaacatatgaaaaaaaaatgctcaacatcactaatcatcagagaaatgcaaatcaaagccacaatgaaataccatctcataccagtcagaatggcgattattaaaaagtcaaaaagcaacagatgttggtgaggctgtggagagaagtgaagacacacactattggtgggaatacaaattagttcagccactgtggaaagcagtttggagatttcttaaagaacataaaatagagctaccatttgaccaagcaatcccactactgggtgtatacccaaaggaaaataattcattctatcaaaaagatacctatacctgcatattaattgcagtgctgttcacaatagcaaagacatggaatcaacccaagtgcccatcagcagtgga

SEQ ID NO: 138614 - DNA, 1225 bp, Homo sapiens
tctttatttttattgagacataatttatgtaaaataaagtgcatgtattttaaatatatagttctatgtgtttatatgaatttatacacccagataactgccaccgtaattaagacatgagacatttccaccgcccctataaatttgcttatgcctctttccatcaattccttccaccacatagacagccattaatctgattttgccactgtagattagtttttcctgctctaaggatttgtataaatggaattatatagtctgtagtctttcatttttttttctttcactcaatgtttttgaaatctatccgtgttgttgagtatatctctagtttgctcctttttattgctgaaaagtattctcttgtataggagtcattacaaatcattacaacatgtggtgttttgtgtctagcttctcttactgattcgttctttgcagaaatggagagccaaaagaattagaaattgaaacttggggaaagaacttgggattccaaaatgggatagaggcagtgtaggttaggatcttggcagcagccaaagtggactattttgagatcaacagagtgatctgtgggaaccttcaaactgagacatatgctgagttgcagtgacagtatcaaaagatctctatatatgagggatatagaatagtcatcattaggagatccgggtcgtattaccatgtttcccttggaaggactggtcttgatgcctccccctggtaattgctgttgttaagcctcttgtgtttcctgaatgtgctcacagattgcattcttgagttttactccgtaattcttgaaccaaacctgcagtgccgttggatgtatgaccatttttgaagctgtttatttctgaaggcttgggttttggtatgggttcttattaaacaagatattcaacacttccacttgtttctcggtgaacataatactttcattgcttctggtgctagcctttaggaaggatctctgagcctgacatttagtttagatgtgttcctatgttcaagtccagtggcaagaagctagcagaatgttgaaaaagaacatcaagtaatttgttttctgtgtggagagataatagaccagatgttattaatgatggaagtaaagaaaaagaaacagtgaggtgattaaaggggtagaagctactcaaatttgttagttgagccatgtgtctggaatttcagttcaaggataagagcttcttcactc

SEQ ID NO: 138615 - DNA, 2208 bp, Homo sapiens
ttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattaga

SEQ ID NO: 138616 - DNA, 1050 bp, Homo sapiens
cagataatcagtgcagactggaaccaacatgtgaaagccctttgaatgctttggaatatctacatactatatatattattactaatattttcaaaattaagagttttcttcagaaattaaaatcctttataactatttataaaatttattctatcttaccatctcctctgaaggcagaaattgtctatttttttaacccgaggaaagaccatgacaccatgagttaattactaagcttatggttgaaggtggagatcctttcttgaaacttgtgtcatctgactgtgttatgcttgcctcctggccatctgtgagccctgggagaagctgtcagcgaggatttgcctgtttgttttcagaccattttccccatcaccctcctaccatcaccaccattgtctttttttgttgttaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagaggtgagggaaccaacagacttgtctttgtacttctgaagcagctgcagggtggtgaagggaagggctgagcaggatccaactaggctctttggggttgtccaacccaccggtatgggcagtaaatggctgggcatgtgccaggctaattttttgtgactgcaatagtcctcagtcccaagcttgattgatcaaagtgtggatgtacctcactggtcttctgagcaatgagctgatgtgttaatcaggcaggatccctgctgggactcctggacccacctggcccacccccacaataggtgctgcctcttctttttaacaggttttacagaggcgtgccctttgactgcaagcttgaagtataatgtcctctcttatttccaggactgactgactccttttatttttgactttcacctgataatattgaagactttgggaaatatttctactttaaagtgccttcagcaccttcaaaactgctaaccttgg

SEQ ID NO: 138617 - DNA, 1050 bp, Homo sapiens
cctgggttctgttctgttcctagtcaatatggtccagccctctcttatgaccttagctgtcatccatatgctaatgactcccaaagatatatctcaacctatctttgatgtcaaattggtcatcacactccatgtcttctactcagcttataggtttttgatattttcctcctcttgggagctttttcaggtagcccagggttttttgcagagccctatgtgttgccggagctattagctcatacctctgttttcccgttgaattgggcctcctctgcctgactgggagctcctcaagtactgggctctctttttatttatttatttatttatttatttatttatttatttatttattgccaccctaggccttacctagcacaatgtctggctacagtaagtgctcagtaaaagtttatggaaaatttgctgtgataagtgtcatcatagagaattcattttccatgttgagcagagttgaggtcaggaatagatggagagggattagggaaaaatcttcaaagagaagatggacagcagaactgccttattttgagagttctggctaagaagtcacggaaggaatgcctgttgtgtccactgttgttaaaccaggggcatctctgacctattgcctcccctgctttaggaccggatgatttttatggtcaggtctgcaaatcaacctctgtctataatacattgaccatttaagacaggtgtcacttagtcatctagtattaaacagggctgaccttaaatgtgccaccttaactgaggctgaaaatagagctacacacacaggctcattgatcatgcctgcttagttctatacagcaaaatgtcccttaagatatattgaagattgggatctaaaaactgacaaattcaattctcagaatgtaagcaggttgggtcacaagaactgaatgtcttcaagctgactgtcagatctttccaagggcaaaaatgaaagatgatataagctattacaggccatgaacctgttttcacccacctgatgcttttactaattagcttcttggctgg
